United States Patent 9,592,283 (IMMUNOLOGICAL COMPOSITIONS CONTAINING ATTENUATED HISTOPHILUS SOMNI) - sequence listing, part 2

SEQ ID NO: 2 - DNA, 2263460 bp, Histophilus somni (TK #21)
  misc_feature (56044)..(56044): n is a, c, g, or t
  misc_feature (78214)..(78483): n is a, c, g, or t
  misc_feature (80086)..(80086): n is a, c, g, or t
  misc_feature (80430)..(80456): n is a, c, g, or t
  misc_feature (81181)..(81181): n is a, c, g, or t
  misc_feature (81344)..(81346): n is a, c, g, or t
  misc_feature (81401)..(81426): n is a, c, g, or t
  misc_feature (81679)..(81825): n is a, c, g, or t
  misc_feature (81904)..(82061): n is a, c, g, or t
  misc_feature (87654)..(87787): n is a, c, g, or t
  misc_feature (88111)..(88269): n is a, c, g, or t
  misc_feature (88385)..(88629): n is a, c, g, or t
  misc_feature (96616)..(98187): n is a, c, g, or t
  misc_feature (240582)..(243086): n is a, c, g, or t
  misc_feature (243320)..(245118): n is a, c, g, or t
  misc_feature (245429)..(254799): n is a, c, g, or t
  misc_feature (255252)..(256829): n is a, c, g, or t
  misc_feature (257050)..(264354): n is a, c, g, or t
  misc_feature (274139)..(274139): n is a, c, g, or t
  misc_feature (285861)..(285900): n is a, c, g, or t
  misc_feature (287250)..(288996): n is a, c, g, or t
  misc_feature (291020)..(291121): n is a, c, g, or t
  misc_feature (291200)..(293227): n is a, c, g, or t
  misc_feature (293503)..(295361): n is a, c, g, or t
  misc_feature (318228)..(318862): n is a, c, g, or t
  misc_feature (334146)..(336310): n is a, c, g, or t
  misc_feature (343724)..(343839): n is a, c, g, or t
  misc_feature (362215)..(362421): n is a, c, g, or t
  misc_feature (362551)..(362570): n is a, c, g, or t
  misc_feature (362642)..(362667): n is a, c, g, or t
  misc_feature (362807)..(364485): n is a, c, g, or t
  misc_feature (364801)..(365041): n is a, c, g, or t
  misc_feature (365653)..(365999): n is a, c, g, or t
  misc_feature (381127)..(381424): n is a, c, g, or t
  misc_feature (382320)..(382566): n is a, c, g, or t
  misc_feature (423702)..(423702): n is a, c, g, or t
  misc_feature (423879)..(424030): n is a, c, g, or t
  misc_feature (424114)..(427569): n is a, c, g, or t
  misc_feature (427666)..(427905): n is a, c, g, or t
  misc_feature (428775)..(429001): n is a, c, g, or t
  misc_feature (429742)..(429850): n is a, c, g, or t
  misc_feature (452294)..(452294): n is a, c, g, or t
  misc_feature (452301)..(452302): n is a, c, g, or t
  misc_feature (452676)..(452676): n is a, c, g, or t
  misc_feature (453811)..(454225): n is a, c, g, or t
  misc_feature (454261)..(454276): n is a, c, g, or t
  misc_feature (454372)..(454492): n is a, c, g, or t
  misc_feature (454600)..(455103): n is a, c, g, or t
  misc_feature (455271)..(455287): n is a, c, g, or t
  misc_feature (455803)..(455835): n is a, c, g, or t
  misc_feature (456064)..(456069): n is a, c, g, or t
  misc_feature (456273)..(456329): n is a, c, g, or t
  misc_feature (457661)..(457789): n is a, c, g, or t
  misc_feature (459179)..(459286): n is a, c, g, or t
  misc_feature (467773)..(468635): n is a, c, g, or t
  misc_feature (481781)..(481812): n is a, c, g, or t
  misc_feature (513755)..(524825): n is a, c, g, or t
  misc_feature (542126)..(542195): n is a, c, g, or t
  misc_feature (552485)..(552485): n is a, c, g, or t
  misc_feature (552722)..(552814): n is a, c, g, or t
  misc_feature (552935)..(553056): n is a, c, g, or t
  misc_feature (553259)..(553381): n is a, c, g, or t
  misc_feature (559245)..(568107): n is a, c, g, or t
  misc_feature (607285)..(607586): n is a, c, g, or t
  misc_feature (607762)..(607768): n is a, c, g, or t
  misc_feature (614920)..(618247): n is a, c, g, or t
  misc_feature (630141)..(634481): n is a, c, g, or t
  misc_feature (664966)..(665370): n is a, c, g, or t
  misc_feature (665529)..(665880): n is a, c, g, or t
  misc_feature (672536)..(676924): n is a, c, g, or t
  misc_feature (692212)..(699567): n is a, c, g, or t
  misc_feature (699813)..(701561): n is a, c, g, or t
  misc_feature (701591)..(701591): n is a, c, g, or t
  misc_feature (704866)..(708630): n is a, c, g, or t
  misc_feature (708811)..(710080): n is a, c, g, or t
  misc_feature (743635)..(743772): n is a, c, g, or t
  misc_feature (754359)..(754359): n is a, c, g, or t
  misc_feature (754373)..(754373): n is a, c, g, or t
  misc_feature (781897)..(781897): n is a, c, g, or t
  misc_feature (806653)..(806653): n is a, c, g, or t
  misc_feature (806954)..(806954): n is a, c, g, or t
  misc_feature (807060)..(807098): n is a, c, g, or t
  misc_feature (807374)..(807374): n is a, c, g, or t
  misc_feature (807737)..(808649): n is a, c, g, or t
  misc_feature (808711)..(810520): n is a, c, g, or t
  misc_feature (811752)..(815282): n is a, c, g, or t
  misc_feature (862746)..(863422): n is a, c, g, or t
  misc_feature (863626)..(863703): n is a, c, g, or t
  misc_feature (864318)..(864318): n is a, c, g, or t
  misc_feature (924643)..(924736): n is a, c, g, or t
  misc_feature (926933)..(928313): n is a, c, g, or t
  misc_feature (936227)..(946008): n is a, c, g, or t
  misc_feature (971157)..(971243): n is a, c, g, or t
  misc_feature (971725)..(971796): n is a, c, g, or t
  misc_feature (971987)..(972171): n is a, c, g, or t
  misc_feature (972312)..(972417): n is a, c, g, or t
  misc_feature (972934)..(972970): n is a, c, g, or t
  misc_feature (974030)..(974324): n is a, c, g, or t
  misc_feature (974786)..(975100): n is a, c, g, or t
  misc_feature (975186)..(975346): n is a, c, g, or t
  misc_feature (975621)..(975636): n is a, c, g, or t
  misc_feature (977533)..(977533): n is a, c, g, or t
  misc_feature (977542)..(977542): n is a, c, g, or t
  misc_feature (977544)..(977544): n is a, c, g, or t
  misc_feature (978176)..(978238): n is a, c, g, or t
  misc_feature (978640)..(978679): n is a, c, g, or t
  misc_feature (981649)..(981729): n is a, c, g, or t
  misc_feature (981832)..(983093): n is a, c, g, or t
  misc_feature (985999)..(990131): n is a, c, g, or t
  misc_feature (991468)..(992180): n is a, c, g, or t
  misc_feature (1003444)..(1004464): n is a, c, g, or t
  misc_feature (1005007)..(1005882): n is a, c, g, or t
  misc_feature (1006201)..(1006468): n is a, c, g, or t
  misc_feature (1006951)..(1007229): n is a, c, g, or t
  misc_feature (1007446)..(1007809): n is a, c, g, or t
  misc_feature (1008027)..(1008530): n is a, c, g, or t
  misc_feature (1008590)..(1012842): n is a, c, g, or t
  misc_feature (1013795)..(1014685): n is a, c, g, or t
  misc_feature (1015248)..(1015465): n is a, c, g, or t
  misc_feature (1015533)..(1018500): n is a, c, g, or t
  misc_feature (1018738)..(1019164): n is a, c, g, or t
  misc_feature (1020779)..(1021264): n is a, c, g, or t
  misc_feature (1021296)..(1023358): n is a, c, g, or t
  misc_feature (1023459)..(1023459): n is a, c, g, or t
  misc_feature (1035314)..(1035535): n is a, c, g, or t
  misc_feature (1035772)..(1035844): n is a, c, g, or t
  misc_feature (1035881)..(1035964): n is a, c, g, or t
  misc_feature (1036715)..(1037239): n is a, c, g, or t
  misc_feature (1048153)..(1048367): n is a, c, g, or t
  misc_feature (1049014)..(1049129): n is a, c, g, or t
  misc_feature (1070386)..(1070386): n is a, c, g, or t
  misc_feature (1090214)..(1090686): n is a, c, g, or t
  misc_feature (1090759)..(1090799): n is a, c, g, or t
  misc_feature (1170142)..(1170384): n is a, c, g, or t
  misc_feature (1172147)..(1172240): n is a, c, g, or t
  misc_feature (1175275)..(1175395): n is a, c, g, or t
  misc_feature (1175441)..(1175847): n is a, c, g, or t
  misc_feature (1176067)..(1176138): n is a, c, g, or t
  misc_feature (1176364)..(1176441): n is a, c, g, or t
  misc_feature (1176466)..(1176466): n is a, c, g, or t
  misc_feature (1176782)..(1176945): n is a, c, g, or t
  misc_feature (1177260)..(1177529): n is a, c, g, or t
  misc_feature (1177629)..(1177931): n is a, c, g, or t
  misc_feature (1180363)..(1180363): n is a, c, g, or t
  misc_feature (1188712)..(1189583): n is a, c, g, or t
  misc_feature (1189824)..(1195495): n is a, c, g, or t
  misc_feature (1306783)..(1307125): n is a, c, g, or t
  misc_feature (1311963)..(1311983): n is a, c, g, or t
  misc_feature (1312039)..(1312639): n is a, c, g, or t
  misc_feature (1313052)..(1313075): n is a, c, g, or t
  misc_feature (1313914)..(1314128): n is a, c, g, or t
  misc_feature (1314785)..(1315512): n is a, c, g, or t
  misc_feature (1319547)..(1320330): n is a, c, g, or t
  misc_feature (1340125)..(1352087): n is a, c, g, or t
  misc_feature (1368237)..(1368949): n is a, c, g, or t
  misc_feature (1417386)..(1418742): n is a, c, g, or t
  misc_feature (1419742)..(1419863): n is a, c, g, or t
  misc_feature (1420042)..(1420042): n is a, c, g, or t
  misc_feature (1420899)..(1420899): n is a, c, g, or t
  misc_feature (1422415)..(1422665): n is a, c, g, or t
  misc_feature (1427370)..(1427455): n is a, c, g, or t
  misc_feature (1427565)..(1428803): n is a, c, g, or t
  misc_feature (1428901)..(1429102): n is a, c, g, or t
  misc_feature (1429479)..(1431000): n is a, c, g, or t
  misc_feature (1441629)..(1441855): n is a, c, g, or t
  misc_feature (1443259)..(1444080): n is a, c, g, or t
  misc_feature (1530876)..(1532616): n is a, c, g, or t
  misc_feature (1535194)..(1535205): n is a, c, g, or t
  misc_feature (1630858)..(1631412): n is a, c, g, or t
  misc_feature (1647213)..(1647264): n is a, c, g, or t
  misc_feature (1649423)..(1650928): n is a, c, g, or t
  misc_feature (1651503)..(1651714): n is a, c, g, or t
  misc_feature (1653270)..(1653319): n is a, c, g, or t
  misc_feature (1689806)..(1689923): n is a, c, g, or t
  misc_feature (1690734)..(1690928): n is a, c, g, or t
  misc_feature (1691374)..(1691557): n is a, c, g, or t
  misc_feature (1691638)..(1691854): n is a, c, g, or t
  misc_feature (1694429)..(1694429): n is a, c, g, or t
  misc_feature (1694441)..(1694441): n is a, c, g, or t
  misc_feature (1709998)..(1710102): n is a, c, g, or t
  misc_feature (1737165)..(1737212): n is a, c, g, or t
  misc_feature (1747647)..(1749384): n is a, c, g, or t
  misc_feature (1752077)..(1753776): n is a, c, g, or t
  misc_feature (1754066)..(1754195): n is a, c, g, or t
  misc_feature (1768955)..(1768955): n is a, c, g, or t
  misc_feature (1769189)..(1769189): n is a, c, g, or t
  misc_feature (1770224)..(1770257): n is a, c, g, or t
  misc_feature (1770372)..(1770676): n is a, c, g, or t
  misc_feature (1771742)..(1771799): n is a, c, g, or t
  misc_feature (1771872)..(1771922): n is a, c, g, or t
  misc_feature (1774054)..(1774175): n is a, c, g, or t
  misc_feature (1775009)..(1775141): n is a, c, g, or t
  misc_feature (1775291)..(1775350): n is a, c, g, or t
  misc_feature (1806519)..(1806580): n is a, c, g, or t
  misc_feature (1807126)..(1808634): n is a, c, g, or t
  misc_feature (1812820)..(1812976): n is a, c, g, or t
  misc_feature (1813846)..(1813928): n is a, c, g, or t
  misc_feature (1814255)..(1814255): n is a, c, g, or t
  misc_feature (1815617)..(1816153): n is a, c, g, or t
  misc_feature (1816480)..(1816603): n is a, c, g, or t
  misc_feature (1817524)..(1817677): n is a, c, g, or t
  misc_feature (1847212)..(1847269): n is a, c, g, or t
  misc_feature (1864711)..(1865746): n is a, c, g, or t
  misc_feature (1865855)..(1866298): n is a, c, g, or t
  misc_feature (1866489)..(1866896): n is a, c, g, or t
  misc_feature (1869364)..(1869790): n is a, c, g, or t
  misc_feature (1870899)..(1871335): n is a, c, g, or t
  misc_feature (1871668)..(1871959): n is a, c, g, or t
  misc_feature (1872655)..(1877886): n is a, c, g, or t
  misc_feature (1892371)..(1892388): n is a, c, g, or t
  misc_feature (1892840)..(1893212): n is a, c, g, or t
  misc_feature (1894204)..(1895192): n is a, c, g, or t
  misc_feature (1902581)..(1902694): n is a, c, g, or t
  misc_feature (1911403)..(1911528): n is a, c, g, or t
  misc_feature (1922073)..(1927414): n is a, c, g, or t
  misc_feature (1927717)..(1927802): n is a, c, g, or t
  misc_feature (1971545)..(1978043): n is a, c, g, or t
  misc_feature (1980864)..(1986181): n is a, c, g, or t
  misc_feature (2038613)..(2038737): n is a, c, g, or t
  misc_feature (2038896)..(2039879): n is a, c, g, or t
  misc_feature (2039971)..(2040034): n is a, c, g, or t
  misc_feature (2040072)..(2040304): n is a, c, g, or t
  misc_feature (2040393)..(2040965): n is a, c, g, or t
  misc_feature (2041004)..(2041219): n is a, c, g, or t
  misc_feature (2041471)..(2043668): n is a, c, g, or t
  misc_feature (2043859)..(2043983): n is a, c, g, or t
  misc_feature (2044360)..(2044504): n is a, c, g, or t
  misc_feature (2044568)..(2044741): n is a, c, g, or t
  misc_feature (2044927)..(2045029): n is a, c, g, or t
  misc_feature (2045164)..(2045164): n is a, c, g, or t
  misc_feature (2118909)..(2123360): n is a, c, g, or t
  misc_feature (2123785)..(2123968): n is a, c, g, or t
  misc_feature (2124728)..(2129316): n is a, c, g, or t
  misc_feature (2129421)..(2137637): n is a, c, g, or t
  misc_feature (2137687)..(2137744): n is a, c, g, or t
  misc_feature (2138635)..(2139224): n is a, c, g, or t
  misc_feature (2139320)..(2140594): n is a, c, g, or t
  misc_feature (2141008)..(2141682): n is a, c, g, or t
  misc_feature (2142071)..(2143906): n is a, c, g, or t
  misc_feature (2160506)..(2163041): n is a, c, g, or t
  misc_feature (2186336)..(2186452): n is a, c, g, or t
  misc_feature (2230137)..(2230241): n is a, c, g, or t
atcaaaaacaacgctcatcaaaaattaagaagcggaattctaatcttaaattcagcgttcgtcaaatcagaatagtcaaaatcgcagaataaagcttatttttccaatcaaaaagcacaagagcggctcggattatacgtttttttacaaaaatctcaagcaacctttttcagtttttttgttcttttaataaagatctttgagccagtttattgtagaattaccctcaatttacaccgcacttttagataaaacttccaactatttaatttgcaaagatggataaaatgagttcaacagtttctacgctatggcgagattgcttattacaattacaagatcaagtatcttcaaatgactttacgacttggctacgaccattacaggacgatgtcagtgagagtaacatgatactttatgcaccaaattgtttcattaaaggatgggttgaaaatcattatctcactcaaatcacaaagcttgctcagcaattgttgaataatgatcaattcatggtaaagatacaagacggcataaaacctactgagaaaacaacaacgaatgttgagcaaaagacacaaaatgaaaactgtcataatgaaataacttcgcaacaaaattaccgctcttatctcaataaaaatcatgtctttgataactttgttgaaggtaaatctaaccaattggcacgagcagttgcccagaaagtggctaaaaatccgggtgagcaaagtgctaatccattgtttttgtatggtggtacaggtctaggcaaaacgcacctgttgcatgctgtaggaaacggcattttagcaaataatcctcatgctcaagttgtttatatgcatgcagaacgttttatgcaatcttatgtaaaagccttaaaatccgatagaatggacagttttaagcgattttatcgtactgttgatgccttactgattgatgatattcaattttttgccggtaaagatggtacgcaagaagaatttttccatatattcaactcgttatttgagcgtggtcgccaaattattttgacttctgatcgttatccgaaggaaattgagaaaattgaagatcgtttaaaatctcgtttcggttggggaattagtgttgctattgaacctcccgaattggaaactagagtcgcgattttgttgaagaaagcggaagaaaaaaatatggttttacccgaagaggtcgccatgtttattgggggaaaattacgtactaatgtgcgagaattagaaggtgcattaaaccgtgttcatgcacatgcggaatttaccggaaaagcgattactattgattttgtacgtgaaactctaaaagacatgttggcattgcaagataaattggtaacaattgaaaatattcaaaaaattgtggcggattattatcggatcaaaatttcggatttaaaatcaaaaagacgttcacgtaatataaccagaccacgtcaattagctatggcattagctaaagaactaacgaatcgcagtcttcctgaaattggtaggaatttcggtgatcgggatcatacgaccgttctgcatgcttgtaaggccatagcaaaactccgagaagaagataatggtatccaagaagattggtcaaatttaatccgcacactgtcagtataagggagcagactatgcaatttattgtttcaagagaacatctattaaaaccattacaacaagtttgtggtgtattaagtagtcgtccaaattttcctatattaaacaatgtattattgcaaattgaggggaatgttttacgtattaccggtacagatctcgaagtagaactttcaacacaagcacaacttattcaagcatcgcaagacggtagttatacgattccggcaaaaaaattcttagatatttgccgcagttttcccgatgaagcggaaattactgtaatttttgaagaagagcgtgcattggtgagatccggtcgaagtaaatttaatttaaccgctttacctgcagacgaatatcctaatttagctgattggcaatcagaggtggatttttacctgcctcaaagtacattacgtcgcctaattgaagcaacacaattctctatggcaaaccaagatgctcgttatttcctaaacggtatgaagtttgaaactgaaggcaatttactacgaacagttgctactgatggacatcgactcgccgtttgcacaattccgttagagcaggatttgcatacacatgcagtcattttgcctcgcaaaggaatattagagttaatgagattactggaaaacagcgaacacgctgctcacgttcaaattggcacaaataatttacgcattgatttaggaagtattatttttacatcaaaattaattgatggtcgtttcccagactatcgtagagttctcccaagaaatgcaactcatattatggaaggtaattgggaactgctgaaacaagcttttgctcgtatggcaattctgtctagcgataaagttaaaactgtccgtttgcaattgacctcaaatcaattaaagattacagcaacaaatccggaacaagaagtggctgaggaaattttagatgtcgtatataatggggcagatatggaagttggctttaatgtgagttacattttagatgtacttaatgccctaaaatgccaacaggtgcgattatgttttactgatgcctcatcaagttgtttattagaggatgctgatgatgaaagtgcagagtatgtcgttatgccgatgcgtctataaacaatggcaatatcacgcttaatcatcaatcatttccgcaacttaacagccatagatctggaatttgaacgtggctttaactttattattggcaacaatggaagcgggaaaacaagtttactggaagctattttttatttagggcatggacgctcatttaaaagtgcggttgcaaatagaataatttcttatcagcaaccgcactttattttacatggtaaaattcaagagcaacaacatcaatggtctgttggtttgcaaaaacaacgtcaaggtaacactttaatgaaaataaacggcgaggacgcaaaaaaaatttccgatcttgcccatttattgcccatgcaactcattacacctgaaggattaaccttattaaatggcggtcccagctatcgaagggcttatttagattgggggttatttcatcataacgcatcattttataatgcttggagtagcttaaatcgtttacttaaacaacgaaattctgccttgcaacaagtttgttcttatgaaaaactcaaaatttgggatagagaattagccaaacttgcttatcaagtgagctactggcgagaagcgtatgcggaagctttacgctcggaaatagaaaaaacctgtcagctttttctacctgaactagaaatttctgttagctttcatcaaggctgggataaaaatatggactatgcggatctgttacaacaaaactttgagcgagatcgtgctttgggttataccttttccggacctcaaaaagcagattttcgttttaaagcaaacggattgccggttgaagatattttatctcgaggacaattaaaattgttaatgtgtgcattacgtttggctcaaggtgagcatttaatgcaacaaaaaaaacgccactgtatttttctacttgacgatttcgcttcagaattggatcaatataaacgcacattgcttgctgaacgcttacaaaaaaatggttcgcaagtttttgttactgcaataactcaagaacaattacaacagatacaaccagaaaagcaccgcactttttaccttgaaaacggaagaataaaagatctttaaaataagcaaaaaataaacctgaccaattgtcaggcttcacatagcgttataaagatttatcttgtaccatacacaacaatagttttgccatgtgctgaaatcaaatgctgatcttctaacattttcaaaatacgcccaacagtttctcgtgagcaacctaccatttgtcctatttcctgacgagtaattttaatttgcataccgtccggatgagtcattgcatcaggcatcttagctaaatttaacaaggtttgagcgatacgacctgtcacatctaaaaatgccagattgcttacctgctttgaagtattttgtaaacgatgagctaattgaccggctaaatacattaaaatttctggattaacttgaattaattggcgaaattttttataagaaatttctgcaatttcacatgagcttttagctttaacccaagccgaacgaggctgtgtttcatcaaataaaccagcttcgccaaaaaaatcaccttgacttaaataagtcaaaatcatttctttaccttcctcatcttttaccatcacggcaacagaccctctaattaaataataaagggtttccgctttttctccagcatgaatgagggagctttttgctgagtatttatgaatgtgacaatgagataggaaccactctaacgtcggatccatcgatggtgctgattgtccttgttgttctaacataaaatctcctagtcattttccatttaaaaaatccattttatttttaatatcaatggattgatgtaactcagaccaaactagtatcgctttcccctgacgaatgtttttaaataaattttctcttttttcggctaatgaaagctcggtactaccataatccgtaccttcacgtaaaataaagctatccacaatatttaataaggtctgctcttctaatttttcccatggaataagcattgcaaattgctccaatcttacctaaaaatttctattatgcaaataaactttccagcagtttccattgttgctcaaaaccttgattaggcaagtgcctaaagttatttcttacgtaacgcataaactgtccctcgcataaagtaacaagatgggaagcaataattttttcatcaagatgaaaagattttccttctctcaatttacgcatttgtagaatattcacaaactgtaattctaaacgatcaaaaaatcgtgcaactcgtgcttgtaactgactatcttcaaacattaaagcatgccctgttaaaattcgggttaatcccggattttttcgtgcaaaatcaagaatagtttgcaaaatatctctcacacgattcatggtattggtttcgttcttgatagagtgattaattcgactaaataaagtattttctatattatccaataatgcttcaaacattttggttttactgggaaaataacggtaaagtgcggcttcagaaacaccgacttcctgtgccaagcgagctgtcgtcatacgctccattcctcgttctgaatgtaacatatgggttagtacggttaatacctgttgacgacgttcttttactgttcgtttctcaattttttgcgttttttgttttgaggcaacaacgatttcagcatcgccaatatccaattgctgttgttccattattttttgcctgaatgaccaaaaccaccattaccacgatctgtttgctgaaattcttctacaatattgaactcagcttgtactacaggtacaaacactaattgtgcgatacgatcaccaatttcgattttgaaaggtttatcacttcgattccaaagagaaaccatgagtggaccttgataatctgaatcgattaaaccaactaaattgcctaatacaatcccatttttatgtcccaatcctgaacgaggcaaaatcactgctgctaaattaggatctgcaatataaatagataaacctgttgaaataagttttgtttctcctggctggacttcaaatccctcgtcaaccaacgctcgtaaatccaatcctgccgatcctatggttgcataagttggtaatggaaactcagttccaatacgtggatctaaaatttttacatcaatctttttcatttactttcttccaatttccatttataacgcacaataattttatcaaccaattgtttagctaagtcacttttatgtttcaatgccaacctctcttgcccattttgccaaaacagctgcaattcgttttgctctgaattaaatacttgcccaccggaaacatcatttgcacaaatcatatccaaatttttacgttgtaatttgtctttcgcatactgctccacattttgtgtttcagccgcaaatcctacaacaaaaggacgattttccattaaattggctacagttgcaagaatgtctggatttttgaccaactttaagaccatttcatcattaccggggattttcttaattttttgttctgcaatttgttctacacgataatcagctaccgctgcacaaccaataaaaatctgattttgttccgcactttgtattgcatgttgatacatttcttgtgccgaaactacattaatgcgttgtacattatgaggtgtcgctaaattgacaggtccactgattaaagtgacttttgcacctcgttgagcaaaagcttcagcaatagcaaaccccattttgcctgagctatgattactaatatagcgtaccggatcaatggcttctcttgttggacctgcggtaatcacaacacttacatcaagtaaatcttgagtatgtaaaaaggattggcaaagtgcggtaaaaatttcaaaaggttctgacattcttccgatacctacatcaccacaagcctgttcaccactattcggtccgataaactgcacaccacgagccatgagttgtgctaaattttgttgagtaacagtttgtgcatacatttgttggttcattgccggagccagaaaaatcggagaattcgttgctagacaaatagtggataataaatcgtttgccataccgaccgccatgcgtgcaataaagtctgcactggcaggtgcaattacgataagatccgcccacttagccaattcaatatgtcccattgccaattcagcttcatgatcaagtaaagattgtgatacagcgttgccggaaattgcttgtaaagttaaaggtgttacaaattctgtcgctgcatttgttagcactactcgaacttctgcttgtgctttacgcaataaacgaattaattctatggttttatatgcagcaataccgccggtaattccaatgacaattcgttttccccgaataagattttgcattgttagtccttaatcacaatccaaagtgcggtcattttactgcaatttttcataagaaaacatttaattttgcgattttgcacgcaaaataaaaaatacagtatttaaaacagcaacaaatcccttcatctttatcgttaaatattttttcctttgctaacaagaattttctatgacacaacaaaatacaactttaatgccgagagaaaaactactgaaatatggagcttcatcacttgatgataaggaattattagcgattttcttacgtacaggtataaaaaattgtcctgttatgcaactctccgagttggtacttgctcatttttcttctttaagaggattaattaatgcagatcaaaagcatttttgccaaatgaaaggattgggtattactcaatttgtacaattacaagcctgtactgaaatgaccaaacgttatctcttacaagaattacagtttgcacaagaatttaccagccctgatacagttcgtatgtatttacagactgaattggaaaataaagatagagaaatttttatggtactgtttttggataatcaacatcgtttaataaaaaaagaggaaatgtttttaggtaccattaaccaggcaaatgtttatcctcgtgagattattaaaacagcactattttgtaatgcagccgcacttattcttgcacataatcatccttccggtgtttcaacgccaagcatggcagacagaaaaatgaccgagaatataaaacaactatcagaattaatggaaatccgtgttttagatcattttatcattggtaaaggtaactatttctcctttgcagaacaaggctggatctaggatcattcgatgaattattcaatctatttgcgtaaatttttatcatttttttcagggaatttatctatttaggcttgagaatgataaacaaaggtcgtataattcacgacctttaatatagtgggtcggctatgcgacctgacgaggtagccttcaaaatcttgaattttgaagtggtccgaaccctaagctcgagcttatatttttattggagattaatatgtctagagtctgtcaagtaacaggcaagcgtccagcagttggtaacaaccgttcgcacgcaatgaatgcgactcgtcgtcgttttcttcctaacttacacactcaccgtttttgggttgagagtgaaaaacgtttcgtaactttacgcttaacagcgaaaggtatgcgtattattgataaaaaaggcattgatgcagtgttggctgaaatccgtgctcgtggcgagaaaatctaaggagctaaaaaatggcagctaaaggtgctcgtgaaaaaattcgcttagtttcaacagctgaaacaggtcatttttatacaacgactaaaaataaacgcaatatgccagaaaaaatggagatcaaaaaatttgatccggttgtgcgtaagcatgttatttacaaagaagctaaaatcaaataatttagttttcacgataaaaaagcccgacatgttcgggttttttattttttcaaattttactttttgccataagatagctgaaagacttactcttggaaaaaaaatatgcctgaattacctgaagttgaaacaaccttaaagggcgtaagcccttatttaaaagggtttataattgaaaaaatagtagtacgtaatcccaaattacgctgggaagtaagtaaagaactcagcacatttaaacacgttaaaattcttaacttaactcgtcgagccaagtatctcattatccacacggaacaaggttacattatcggacatttaggtatgtccggttcagtccgcattgtgccgcatgacaatcctgtcaataagcatgatcatttcgatattgttatgaacaacggcaagttactacgctataacgatgctcgtcgctttggtgcttggctatggacgaataaccttagtgaatttcatctttttttcaagttgggaccggaacctttatctgaaacgtttaattctacttatttgttcaaaaaatctcgtcaaaaaagcaccgcacttaaaactttcttgatggataattccgttgttgtaggggttggaaatatttatgcgaatgaaattttatttctatgtggacttcatccacaaaagatcgccaaaacattgacaaaaaaacaggctgaacaacttgtttttactattaaacaagtgcttaacgaagctattgaacaaggaggaacaaccctaaaagattttttacaacctgacggtcgccccggatattttgctcaaaaacttttggtttatggaaataaggacaagccttgtccaaggtgcggtacaaagataaaaagtattattattgggcaaagaaatagctttttttgtccgcaatgtcaaaaaaagtgacattattttctttgtttttaaaaaaaaatatgctaaacatcaataatgtctttttattttcacaatcagtaaacgcaaaaaggaatatgtaatgaatggagcaaatttggtcgtagaatgtttaaaagctcacggcgtaacttccttatttggctatcccggtggggcgataatgccagtttatgatgcaatttatgattctggtttagatcatctactttgtcgtaatgagcaaggtgcagcaatggctgctattggatatgcaagatcaacaaataaagtcggtgtttgtattgcgacgtcgggaccgggggcaacaaatttaattaccggtttaggtgatgccttgatggattcaattcccattattgcaattaccggacaagttgcctcaaattttatcggtacagatgctttccaggaagctgatattcttgggttgtcacttgcctgtactaagcacagttttatcgttcaacatattgatgaattacctgaaatcattgcgaaagctttccaaattgcacaaagtggtcgtcccggtcctgtgcttattgatcttccaaaagatgtgcaatttgcacctacatccttaaaacccattgtttatcccaaaattgcggattctttacaaaatttagtcgcacttgagcaagcgaaaaatttactttctcaagcaaaacgccctgtgctttatgtaggtggcggtgttggaatggcaaaaagctcggatggtatgagtggcgtaaaagctatacgcacttttcttgatataacaaatattccgtcagtatcaaccttaaaaggtttaggaacaatacctctaaaacatccactctatatgggaatgattggaatgcacggtacaaaagcggcaaattatgctgtgcaagaatgtgatttacttattgcttgtggggcaaggtttgatgatcgtgtaacgggaaaattagatacgtttgcaccacatgctaaagttattcatattgatattgatgttgctgaaattaacaaactccgtaaagcagatgttggactacaaggggatttggtggaggcggttactaaccttgcccaactattggatattgaaccgtggcgtaaagatattgagcagttaaaagcaagttttgattttaattatattgaaaatacagaagataaagagatagagccctgtgcattacttcacacattatccgaacgcaaagcaaaaaatgcggtgattacaactgatgtagggcaacatcagatgtggtcggcacaacatatgaaacattatgaacctgaaaattatattacatctgcagggttcggttcgatgggcttcggtttgccggcagctatcggtgcggcaaaagctcgtccccaagatccagttattttaattactggtgatggctcattgatgatgaatattcaagaattgggttcgatcaagcgtggaaatttaccaatcaaaattttattgcttgataaccaacgtttgggtatggtgcgacagtggcaatcgctcttttttcatggtcgccatagccacactgttttagatgataatcctgattttgttactcttgcttctgcctttggtattgcaggtgaacgaattgaaaaggcaagtgaagtttccgatgctttggatcgattattaaatgccaaagaagcttatttactacatgtctgtatcccagatgaagaaaatgtatggccacttgtaccgccaaatacatgtaacagtaatatgattgaagaagatattggggtgtaaacaatgaaaacttacgatttaactattcaagcaaacaaacgccctgaaactttggagcgtttgttaagagttgtccgccatcgtggttttgaagtcattattctacatagtgaaagtaaaggtaatgttattgatttgagacttactgtgcaaagtgagcgagctattgaattattgattcaccaattagtgaaattaccggatgttattacattaagctaaagagcggtctaaatttgtataaattattatacaaaatagatggttagtttaaagggagataagttgtggaaggtgctgttttagcgattaaattgggattggttgaagagattgtttttgaaaatggttcaaagatgtcaacggcaattcggaaaaaaccgatggaacaagctatcgttcatgaattaggtgcggaaggaaatgatgttggactgaaagcacatcatggaggcattgataaagcactgttttttatggctgaaagatcttttgctaaattaaccgctcttttgggtaagcatgatagctatcaaggagaagctatctatggtgaaaattttattgtttctttttttgatgaagaaaatgtatgtgtcggcgatcagtaccagatcggagatgtacaaattgaaatttcacaacctcgcataccttgtgaaacgttgtcaaaaaatgccaataataaaaatactcgagcgattgttgtagaaacagggctgaccggttggtatgtgagagtcattaaaaatggcgtgatcaaaaaaggggataaaatccggcgtttagctaacccttacccaaaattaaccattaaatatttaaattatttgctggcaacggaagcgactgtggagcttaaaactcaattagaacaagcaattgaatgtcctgttttggcggaggcttttaagcgttacttaaaaatgaaatggcgaaaaatcagttaaatatttggttaagtgagatattattaatcgacttatgtgaagaataaagaacgtgattaaatatttactgatataatggcgaaaatttttcagataattttaacaagcggtctctaattttgaatatttctttatttcgacaaattctctcctctacaaaatggcagaatgatatttttactttatctccgcaaaaacaagattggctattacatcaaggttcattaactcgaaaattacagcaatattgtcagcaactgaaagttgaaattgtggcggaaaaatgggtttctgacatgtcttttggatttaccggacatcatgagccaatttggttgcgtgaagtgatattaaaaggtgatgagcaagcttggatttttgcacaaactcgtttgccacaatctacgattgagaatgttgcacctgacattatcaatgtaggttcaacgcctattggcttatggcttttccctcaacaaccaaaaagaaaaacacttgaatggatatacgataccgcaacaggattatatgctcgtcgttcagtattgcttttaaatcaatatccaatcgaaattaaagaattgtttttgcaagattttaaattttttcaatcaaaggtctaaagcatgagaaccccgaaaaagacaaacaaaaaagcgaaaaaaatcaccgcacttacagaagatccgtattttttccaagagcaacagaaatattctaatccaatcccaagtcgagagtttattttacaaattattcgtgattttaatgcacctatgtcgaaagaaaatcttttcaagacattggctatcgttgatcctgaacaaaaagagggaatgcgtcgccgtttgcgtgcaatggaaaatgaagggcaattggtctttactaaaagaaagtgttacgccttgcctgaaaaattggatttattaaaggggtcagtgattggtcatcgtgaaggctatggttttttacaaatcgaaggaagcaagtcagattggtttattccaaatattcaaatgcaaaaagttatccatggtgattttgtattggcacaacctaatggctatgaccgtaaaggacgttcagaggtgcgtattgttcgagtgttagaaagtcgcaataaacatattgttgggcgttttttcatggaggaggggattggttatgtcgtgccggatgatagccgtattaatcgtgacattctgattccgaatgagtttcgcaacggagcgagaatgggacaggtagttgtggttgaacttaaacctcgtacagcaacatttacgcagttggttggaaaaattgtagaaattcttggggagaatatggcaaagggaatggaaactgaaattgctattcgcaatcatgatattcctcatatttttccaagtgcggtagaaaaacaagtaagaaaatatacggatagtgtgccagaggaagcaaaacaaggacgaagagatttaagaaccttaccattggtaaccattgatggtgaagatgcacgagattttgatgatgcggttttttgtcaaagaagtggtgatggcgggtggacattatgggttgccattgccgacgtgagctattacgtacgtttgcgtactgcattagataacgaagcatatcagcgtggcaattcggtttactttcctaaccgagttgtaccaatgttgccggagattttatcgaatggattatgttcgctcaatccacaagttgatcgtttgtgtatggtatgtgagatacgaatttcgccacagggaaaaatgactgattacagtttttatgaagcggtcatgaactcatatgcaagattaacttacactaaagttgcacaaattttggcaggtgatgaattattacaacaacgctatcatgttttagtaccgcacttacaagaattgcaccaaatgtatcaggctctgctgcaagctcgttatcagcgtggagccattgattttgaaactattgaaactaagtttgtcttcaatgaaatgggacgtattgaatgtattgaacctatggtgcgtaacgatgcccataaaatcattgaagaatgtatgattttagcaaatattgcagcagctaattttatggaacgtcatcaagaacccgctttattccgtattcatgccggaccaagtcaagaaaaactcagtgcatttcgtgcttttctacgtgaatgtggcttaacgttaaaaggtggtataaaccccacaaccgcagattacgcacagttgttagcccaagttcgtgaacgtccggatcatgaattaattcaaactatgctacttcgttcacttagccaagctgtttatcaccctgataatattggacattttggtttagcactaacggaatatgcacattttacctcgcctattcgccgttatcctgatttaacgttacatcgtagtatcaaatatttattagcaaaacagcaaggttctaaaagaaaaacaaccgataccggcggttatcattattccctggaagaaatggatcttctcggtgatcattgttctttaaccgaacgccgagctgatgatgcaacaagagaagtggtagattggctaaaatgcgaatatatgcaagatcatgttggagatgaatttgacggtattatttcttctgtaaccggttttgggttgtttgttcgtttagatgatttatttattgatgggctagttcatatttcaaccttagataatgattattatcaatttgactcaataaaacaacgtttaattggggaaaattccggtacgacctatcgtctcggtgataaagttaaaatccgtgttgaggcagtcagtttagctcaacgccaagtggattttgttttattatcgagtcagcgtaaacctggacgttccggcaaaacggcgaataagcgagcgaaacaaaaaagcttccaagaaaagaaccgcacttctaagatcgagcgacataaaagtgcggtaaaaataacaaaaaaattatcaaaaaaacaacaaagtccggcaagtaaaacaagaaaacagaaaaaacagaaaggataaaaaatcatggcagaaaatatttatggaattcatgcggtgcaggcttttcttattaatgcaccagaacgtttgatcgaagtttatgtgctaaaagggcgggaagataagcggttacaatccgtactgaatgagctttataaattaggtataagcgtacaatttttgaatcgtgatacattggataaaaaagcgaacggagaagtacatcaaggtatcattgctcgtgttcaaccagctaaagagttgaatgaaaatgacttggttgagatcttacaaaaaaaagcaaatccattattgctggtactggatggtatcacagatccacataatttaggtgcttgtttacgatcagcagatgctgccggtgtttgtgctgtgattgtaccaaaagataaatcagcacaattgactgcgattgcacgtaaagtagcttgtggggcggcggaggttgttcctcttgttcgtgtaacaaatttagcccgcactttacgagatctacagcaacaacataatatttgggttgtaggtacggctggcgaggcgattgaaactttatacgaagcgaaattaaccggcggtttagcacttgttatgggggctgagggagatggaatgcgtcgtttaacccgtgaaacttgcgatcaattgattagcattcccatggcgggttccgtctcttcattaaatgtttctgttgccacaggcgtttgtctatttgaaattgtgcgacaaagattagggtaatactttcttaatctaaaaaggttggatgtgatgtgaaatatgtttattatgtaaattaaaaggactgaaccctgcagaatacagagtgcagtccttgaattaaatcagtccaatcagatcatattgtcaggaaatttttgctattttatacccttcttatctagtttttcatacgtttgacagccaatgtttaagccattatcgcacgctaatctataatattgtttagctttagaaacatttctttgtacaccctgtccgtwtkcrtacatcamrccgagattgtrttgtgcatttgcatmtccctgttcagccagttgtttgaataagggaaaagcgtcagaataattttgttgtttaataaattgtaaagcacgattaaatctttcggtatctgtttcggcaagtgtagattggacaataccgaaagagagtagagcgataagtatggatttttttagattcatctgagctcctttgttgactgcttctcatggttcgtttaaaaaattagatatttaagttaattgcatcatcaataaagtattggtccatatcaaatgcaggtttcgcccctttatttttgcctactatttgagaaggcacaccagcgacagtagtgtattctgaaacggattgtaacactacggagtttgcaccaattttagcgtaacgcccaatttcgatatttcctaacactttagctccggacccaatcatcacaccttctcgaattttaggatgacgatcgccgctttctttacccgttccccctaaagttacaccttgcaaaatagatacatcattttcaatgacagatgtttctcctatcacaatacctgtggcatgatcgaacataatgccgcaaccgattcttgctgcgggatggatatctacatcaaaggcaacggatatttggttttgtaaatagatcgccaatgcttttcgtccttgttgccataaataatgggtaatacgataactttgcaatgcgtggaagcctttcaaataaagtaacggtgtagagtattgttctacggcaggatctcgatgacgcacggctcggatatcgcaagccgcactttcgataatttgcggttgattttgatgtgcttcttcaataatttctcgcaatgcaatagcgggcataattggattagctaatttgttcgcaagaatatagcttaatgcactgcctagattgttatgttttaagatagttgcatgaaagaaactggctagcattggttcattttcagcgagttttgctgcttcagcacgaataagactccatacttctattgacatgttactcccttttgcgttttcttcccaataaagtaatagccgcatcttcaggttttttaccacaaaatagtatttgatatacctgctcggtaatcggcatttctacaccctgttgctgggctaataaaaaggtttcttttgtattgtaaaaaccctctataaccggaccaagttcattgatagccgttgtacaatcaaaaccttgtcctaacattaatccaaaacgacggttacgagactggttatcggtacaagtaaggactaaatcccctaagccggatgttcccataaacgtattcggattcgcacctagagatatgcccaaacgactgatttcagcgattcctcgagtaattaatgctgtacgtgcattagcaccaaaccccataccatcagaaatccctgcagcaatagcaattacatttttaaccgcccctccaagttgtacaccaatcatatcttgattaacatagactcggaatttgctacaatgaattctttcttggaactctaaggcaaattgttcgttatttgaggctaatgtaatagctgtcggcatgccggcagccaattctttagcaaaggtaggtcctgataagactgctaaaggataaccatatcctacatgctcttcaacaacttcttgtaataagcgtcctgtatttcgctccagtcctttcgttgcccaagcgatacgttgatccgatcttaagtgcggtttaatttgcatgataacgtcgccaaaaacatgacttggtacaacaattaataactctctggagtgttgaatggcttgtgctaaattgtcttctacatataaagaatcaggaaagtgaatattaggtaaaaatgcttgattttttcgctcattacgtaagcgttgacaatgttgaggatgatgtccccataagtaggttggatagccattgcgagaaaaggcaatagctaaggcagttccataagcaccggcaccaattacggtgattggagttggagaaggactgttatcattcatattttttcttagaattttcggaattaatagaaatcttagggtgttattacaacaccctgagagattaatggacttctttcttttctttttcttcagcttttgactcctcttgtgtttgttgacgttgcatatactcaacaaataaggcatcaaaattgaccggtgctagatttaaagccgggaaagtgccacgattcactaaactggaaattaattctcgtgcataagggaataacatatttgggcattgagatgttaggcaatgtgctaattgtacatcttctaaaccgcttatagcaaagatgcctgcctgttttacttcacagataaaagcaacatcttcactgccttccattgtagtttcaacagagatattcaggcaaacttcataaagatcttctgctaaatgggttgtttctgtgcttaaattaaaatctagtttcggtttccattcttgttggaaaatgtgtggtagattaggtgcttcaaaagaaacatctttaacgtaaatacgttgaatttgtaaaacaacttctgttccttgttcttctgttactgcatcttgatttttttctgtcatttttcgatccttatttatgttttttgactaaaggtaaatttgccgcaatccagccactgataccatctttcagtgagtaaactcgactaaatccttgtttaactaataattctgctgatgcacctgcattcatacctgttgcacaaactaaaattacaggggtatctttatgttgttcaatttttcctaaattttgatttttaatctctgttggcaatacattgatactgttgataatatgaccacgttgaaattcatctattgtgcgtaaatcaataacaatagcctcttcattattaattaaacgagtcgcttcggcgttttctactgccgtaactttactggtaaatgattttaccgatgtataaattaacatgacaaatacggcaatccatgctattaccattaggctatgattttttgcaaactctgttgctaaagggagatattcttgcattttttctatttttcaaggttaaagttaaggttaaaaataaagggctaagtataaccgcactttcttcatctttcaaaatttttcaaagaaagtcctgcaaataaattgatctatattatagatagcctccctgtttattggtatattagccccaaatttcaaggaagtcttgataactttgttgaaatagggtttccgattttatcggaaacgatttttaagtagaaaaaataggaaaaaaaatgttttatattcaattcgctatcgttttagtgtgtattctgattggggcacgcattggtggtatcggtttgggcgttatgggtggtttagggctttgtattctcgccttcggcttcgggttacaacctgctggattaccgattgatgtgatgtttatgattatggctgtagtttctgccgctgctgcaatgcaggcagctggtggtttggattatatgatcaaaatcgcaaccaatattttacgcagaaatcctaaatatatcacttttgtcgcacctgccgtaacttggttatttactttcttagccggtactggccatgtagcttattctgtattaccagttatcgcagaagtaagtcgtcacagcggtattcgtcctgagcgtccactttcaatggcagtaattgcatcgcaatttgctattgtagcaagtcctatcgctgccgctgtagtggctgttgtgaactatttagaaccacaaggaatcaacttgggtagcgtcttaatggttactattccgtcaactattttaggcatagcacttgcttgtgtttttgtcaataaaatggggaaagaattaaaagacgatccgaactatcaacgtttattacaaaatcctgagtatgtcaaagaaaacagcgtaagtaatattgctgaaattgaaataaaaccgactgcgaaattatcagtgggcttattcttattcggtgcattacttgttgttgtgatgggagcgtatccagagttacgtccatcattcaacgataaacctatgggtatggctcacactattgagatcgttatgttaaccgttggtgcattgattatcttaacctgtaaaccgaatagtaacgcaattacacaaggttccgtattccatgctggtatgcgtgcggtgattgcaatttttggtattgcttggttgggagatacgttgatgcaaggtcatattgcaggcattaaagaaagtgtgaagttattagttgaaaccgcaccttgggcatttgcatttgcactgttcttactttctgttttggtaaacagtcaaggggcgactgtagcaactttatttccgctaggtattgcattaggtattgaacctgcgattttaatcggggtatttgtagcagtaaacggttatttctttattccaaactatggtccaattattgcttcaattgactttgatacaacaggcacaacaagaattggtaagtttatctttaatcacagctttatgcttccaggtttattaagtatggcatttagcttaggtttcgggttattgtttgcaagtattttactttagctttcactaaataatttataaaaacaccgcacttattttaagaagtgcggtgttttttgagattttgattttttaaataccgaataaaacagcaatgaaaacggtcaagccgaaataattgttatttaaaaaagcgttaaagcaactcgctctatctctatttttagtcaaacggcattggtaaacgaaaaataagccggcaatagccaatacaataaaatatctgttatttaattgtgataaataacccacggaaaagagaaaaatcagcgttattatttgtaataatgcaatgattttattgtcatattgagcaaataaaatcgccgttgatttcactccaatacgcaaatcatcatcacgatctaccatggcatattgagtatcatatgcgactgtccaagataaatttgcaataaataataaccagcattctagaggcaatgcttcaatagtcgcaccataagccattggaatagaccagccaaaagccgctcctaagaaaaattgtggcaaatgtgtataacgtttcataaagggataaataaatgccaaaatgactgcaatcacagataaaccaatagtataaaggtttaaacaaaggactaataaaaaagaacaaaaaacgaggacgataaataaccattttgcttcacgaggtgttgctcgacctgttgaaagtgggcgtagtgaagttcgtttaacttttccgtcaatatggcgatctgcataatcattgatgacacaacctgctgaacgcattaaaaatacgccgcatataaaaattgctaaaactgatagggtaggcatcgctttttcggcaagatataatgcccaaagcgttggccaaagtaaaagcaatgtgccgataggtttgtctaaacgcattaattgtccataagcaatcagcttatcttttgcaggtattgtcatttgattggctaaaccttgtaattcttaataaaagtgcggtgtattttactgtaaaatcctttttggaaaaagtgagtttaccctataaagaaacagtgttatattgcgaaatacttttattgttaaactatcataaaatgactacattcaaagaaatcaactctgaacaagcatgggaaatattaaataataagaatgctgtattagtagacattcgtgatttatcccattttatttacagtcgtccgcaaagtgcttttcatttaactcatcagcgttttagtgaattccaacagaaatatgaatacgaccaaccgattattgtgagttgttatcatggtgtgagtagccgcaatgtggcacaatttttagttgagcaaggctatgatgaagtttatagcttaattggaggtttcgccggttgggtacaagcgaatttaccggtggaaagtggatattaaataaaaggcagatgatttctgccttagttcagtccaaccgcacaaacatagatcaaaacactataaaaaatcaccgcacttagtagcaaaacatattttgccagcttactgttacgttgatttaatttaaatgaataacgagcaataatgcctaaaataaaaggataagcccaaaagaaaattgacatccatctcatttgaaaatcatccaaatttggatttttaatgaaattaggtgagattaagagagctaatggccaaagcaaaacaggtaggcaaaacccaacgagtgcccaagaaaatttactaaatccggttggcatgttttgttttttcatttttatcctcgataatatatacaagagaacaggaatatagcaaatgaaactattatttggtagtgaaagagagaattttattatttggtttcgtgattatatccgagctaagtatttgcttgaattgaccattcaaaactatattgatgaaaaatacaatcggtcggtgcgtggtgtttttatagaagaaaatcatccattattgacacagcttgaacaagagaaaatactttttttgcaggatccttttaacccttgttatcagcaggcagcttgggaggccggcgatacacattccattcagtacaaaaaaacatcatgggtggctatttggaaaatctcatcgaaatggttccaacaaggtaaaataactttatttattaccgcactttgcactctaatttacgttttacagaacttgggatttgagcaaggtattttctattttgctcattatccagcaaatccggcacaacaaacagaaatttggcgttatatttcgcatagtttagtgcatctctcgccactacattttttatttaatctaagttggttttggttatttggcggggcaattgaacgacagctgaatgcaaaaaaattactgttgctcttttttgtttcatctattttgaccggagtcgtgcaaaattatttctctgattatcgtttcttcgggttatctggtgtagtttatgcggtattgggttatgtatttattttagataaatttcattatgctaaatttgctttaccatcaggttttttcttgatgttaattatggggatcgccttaggttttattagtccgcttgtaggtatttatatgggcaacagtgctcatattagtggtttattatgtgggattttattaggcttatggcaagttaaaaaaagggagttttgagaactaaacgtaacatattgaaatcaatgaaatgtgtattgtcttatttctatgctctttcaaactcaagataaaatagatcgaaatttggaggatagagataaacgctgtcttgaagagaaatttattttgccattatggttattcttaattttcgcataaaatttgataatttcctttgactaattgacaatcaaaaggtaatattcacgccctatgcaaaaggtaaaactacccctaactgttgacccgattaaagatgcacagcgtagattggattatcaaggttgttatgtgtccaatcaagttactcgtttagcggagtcagtagtcaaagtgctcagcgatgtgcaggtaacattatcgtttttcgttgatccgcaaaaattgactgtaatgaaaggaagagcgagtgttgatgtggaattagaatgtcaacgttgtggttgtcctttcagtcaatcattggaatgtgagttttcttatagtccagtgtctgatttgggtaagatcaatgaattgccagagatttatgaaccgatagaattaaatgaattcggggaaatagatttaattggaacggttgaagatgaactgattgttgctcttccaattgttccgatgcattcatctgaacactgtgaagtgtccgtggctgaacaggtttttggcgaattgccggaagagctggcaaaaaaaccgaacccgttcgctgtattagctagtttaaagaaaaagtaaatttaggagtatagccaatggctgttcaacaaaataaaaaatctcgttcacgtcgtgatatgcgtcgttcacatgatgcgttaaccactgcagctgtatcggttgacaaaacaagcggagaaactcatttacgccaccatgtaaccgcagatggttattatcgtggtcgtaaagtgatcaataaataatcgttgattgtttaaggtaatcacttgagtcatctaactgttgtgttagatatgatgggcggggacatgagtccccgtattactatctgcgaattggtaaaagcgttgggcaggtatccaatgctgtctttgttgtttgctaataaccaacaaatttttcctctacgtcaacgttttccaatcggtagtcaaaattatttagccgtctgtcattgctctcatgtgattgaaaataatcagtgtttagttcataccttagttcatatttttgtagaataccagctaggtttattttatctatatgcagctttgttaaatataggtattgaggaaactaaagaatataaagaatataaagctattcgagatatggcattataatcttcaaagaaaggttaaagaaaatcttgccggtttgaataaaattaagacgtaacttgatgagataattatgtacagtagaattttagcaaccggtagttatataccggctaatatcaggactaatgctgatttagaaaaaatggtagagacatctgatgaatggattactactcgttccggtataaaagagcgtcgtatcgccggtgaaaatgaaacagttgccacaatgggatttgaggccgctaaaaatgcacttcagttagccaatatttgccctaacgatatcgatttggttttggttgcgactactagccactcctatgcttatccaagtgctgcatgccaaattcaaggtatgttggacattgatgatgcaatttctttcgatttggcggcagcttgcacggggtttatctatgctttaagtgttgcagatcaattcattaaaacaggtaaagtaaaaaaagctttagtgattggtgcagatattaattctcgtaagttagatgaaacggatcgtagcactgttattttatttggtgacggtgctggtgccgtgatcttggaaagcagcgatattgaagggattatttctactcatttacatgcttctttagataaaagtaacgccttaattcttcctcaaactcaacatggtgaagcacaatccggttatattcaaatgcaagggaatgcaacttttaaacttgcagtacgagaattatctaatgtagtagaagaaactttacgtgataatcacttagacaaagctgatttagattggttggtacctcatcaagcaaacttacgtattatcacggcaactgctgaaaaattgaatatgtctttagatcaagtggtaattactttagacaagtacggtaatacaagtgcggcgacagtacctgtggcattggatgaagctatacgtgacgggcgtattaagcgtggtcaattattattattagaagcatttggtggcggttggacttggggttctgcgttggttcgtttctaaattttaacaaaaattgaatatacttatttagtaggaaataaaaatgaaaaaatttgcaatggttttccctggacaaggctcacaatcagtgggaatgctggctgaattggctgcagaatatccgattgttgaagaaacttttcagcaagcttcttccgttttgggttatgatttatggcagttagtgcaacaaggtcctgcagaagaattgaataaaacgtggcaaacacaacccgcacttttagctgcttccgtggcaatttatcgtgtatggcaacaaaaatatcctcacctaaaacctgaagtgatggcaggacatagtttaggtgaatattccgctctagtatgtgccggtgtaattgatttccaagatggaattaaattggtacaacttcgtggcaagttaatgcaacaagcagttccggaaggaacaggtgccatgtacgcaattataggtttagataatgaaagcattgttcaagcttgcaaagcgtctgaacaaggtgagattgtgtcagcggtaaactttaattcaccgggacaagtggtgattgcaggagcaaaagtcgcagtagaacgtgcagctgttgcttgtaaagaggcgggagcaaaacgtgcgttgccgttagcagtcagtgtgccttctcactgtgcattaatgaaaccagcagcagaagaattggcagtagcgttagaaaaaatgacgtttagcatcccacaaattccggttattaataatgttgatgtgaaagcagaaaatgaaaccactaagattcgtaccgcacttgtgcgtcagctttatagtcctgtacgttggactgaaatagttgagaatatggcaagagagggaattgaacttttatttgagatgggacctaataaggtgctcactggattaactagtcgtattgttaaagagttgaatgctaaagcagtcaatgatttatcttcattgaatacagtggaagaaagcttagattaatttatgacaacagaggctgatactaaacagcctattttattgaggagtagatgatgcaaggaaaaatagcattagtaacaggtgctacacgtgggattggacgtgcaatagcagaagaattagcgagcaagggggcttttgttattggtactgcaacaagcgaaaaaggagcggaaagtatttctgcttatttaggcaaacagggtaaaggtttggtattaaatgtcgcagatcaagattcaatagatgctgtattgagtgccattaaagctgaagtgggtgatgttgagattctagtgaataatgcaggaattacccgtgatggtttattaatgcgtatgaaagatgatgactggtttgatattatgcaaactaatttaacgtctatctatcgtttatctaaagctgtattacgtccgatgatgaaaaaaggtggacgcattattaatattggttcagtagttggctcaatgggaaatcccggtcaaactaactattgtgcggcaaaagcgggtgttattggctttacaaaatcgttagcaaaagaagttgcagcaagaggagtaactgtgaatgttgtagctccaggtttcattgcaacagatatgacggatgtgttaactgacgagcaaaaagcaaatattctgacaaatgtgccgacaggtcgtttgggacagccaaaagatattgcgaaagctgttgcatttttggcatcggaggacgcgtcatatattacaggtactacattacatgttaacggtggaatgtatttaccttagtagaaagagggatttcaggctagccaaagataaggcgtaatgttaaaatcctgacatgtggtaatgtagctattgaaacaatcgagttacgttggctgttgcattctacaggttaacataacgtatttatgtttgtgtactgagacaggtatcattgtggtttgaccttgtaaaagtaaaaacagcttgaaacttcataaaaaatacatacactattatatcttatcgctaaccattaataggaaaaaagcaaaatgagcattgaagaacgtgtaaaaaaaatcattgttgaacaattaggtgttaaagaagatgatgttaagcctgaagcttcatttattgaagatttaggtgcagattctttggatacagttgaattagtaatggccttagaggaagaatttgatattgaaattccggatgaagaagctgagaaaattacaacagttcaatcagcaattgattatgttcaaaataatcaatagtaatgatacttgaaaattacacatgaaatcagtataatccgtattcacttatgaccctttgacagggtcatatttttgtgtggcacattgtgcttgtatgaaatggggagctgaaacggcgttattacccgcaaagaggaaattaaaaatggcaaaaaaagtccaagcatacgttaagttgcaagtcgcagcaggtatggctaacccatcaccacctgttggtccagcattaggtcaacaaggtgtgaacatcatggaattctgtaaagcatttaatgctcgtactgagagtctagagaaaggtttaccgattcctgtcgttattactgtttatgcagaccgctcttttacatttgtgactaaaactccgccggcagcggtattattgaaaaaagctgctggaattaaatctggttctagtaaacctaataaagataaagtaggtaaagttactttagatcaaatccgtcaaattgctgaaactaaagcagccgatatgaccggtgcaacaattgaaactaaaatgaaatctattgaaggtacagcacgttcaatgggtttagtagtggagggttaatctaatggctaaacttactaagcgtatgaaagcaatcaaagccggtgttgattcaacaaaacaatatgaaatcaatgaagctattacggtgttgaaacaattcacttcaacaaaattcgttgaaagcgttgacgttgcagtcaatttaggtattgatgcacgtaaatcagatcaaaatgtacgtggtgcaaccgtgttaccacatggtacaggtcgttcagtacgtgttgctgtgtttactcaaggtgctaatgttgatgcggctaaagcagctggtgctgatttagtaggaatggaagatttagcagagcaaatcaaaaagggtgaaatgaactttgatgttgttattgcttcccctgatgcaatgcgtgttgttggtcaactaggtcaaattttagggcctagaggcttaatgccaaatcctaaagttggtaccgttacaccaaacgttgctgaagcggttaaaaatgctaagtccggtcaaatccgttaccgcaatgataaaaacggtattattcatactacaatcggtaaagcaaatttctctgctgaacaattaaaagaaaacttgcaagcattattagctgccttgactaaggcgaagcctgcgacagcaaaaggtatctttattagaaaagtaagtgtttctactactcaaggtgcgggcgttgctgttgatcaaagtagcttataattaatatagccaaacctttacagaggcgtattttgtatatataatgcacgcctctattttgccttatggcataatttctggttggtgcttgacctctcaagccccgtccaagaccgtaggggaaagaatatttcttaataatcctacgtagatggtgatacagaataagaatttttcttgcttctgtgcaccttagcctcagagaagactgcaaaagtgcggtgtttttttgagaagttttataattccgatcaatcggagtgtattcaggagctaaaagccaatggcattaaatcttcaagacaaacaagcaattgttgctgaagtaaatgaagcagccaaaggtgccctatcggcagttattgcggattctcgtggtgttactgttgataaaatgactgagttacgtaaagcagctcgtgaagctggcgtttctatgcgtgttgtacgtaatactttattacgtcgtgcagtagaaggcacagattttgagtgcttaacagatacgtttgtaggtccaacacttatcgcattttctaatgagcatccaggtgcggctgcacgtttgttcaaggattttgctaaagctaacgataagtttgaaattaaaggtgcagcctttgaaggtaagatccaaaatgttgagttcttagcaacattaccgacttacgaagaagcaattgcacgtttaatgggtactatgaaagaagcagcggcaggcaaacttgctcgcactcttgcggcataccgcgacaaattacaagaagcggcttaattaaagcctttcttaactcgtttaatttatttactttaggaattgattgttatgtcattaactaacgaacaaatcattgaagcgattgcttcaaaaactgtcactgaaatcgtagaattaatttctgcaatggaagaaaaatttggtgtttctgctgcggcagcagcggtagcagtagctgctggtccagctgaagtagctgaagaaaaaaccgaattcgatgtggttttagctgaagctggtgctaataaagtagctgtaattaaagcagtacgtggtgcgactggtttaggcttaaaagaagctaaagacctagtagaatctgctccggctaacttaaaagaaggtatttctaaagcagaagctgaagcacttaagaaagaattagaagaagctggtgcgaaagtagaaatcaaataattttgattttttcaatcttctagttcagaaaagacttggtggacaccccaaggtcagaataataatcctaccttttcgtgcgttttcgaaggtgggattattcttttttatgctgtcgaagagtttatttgtagatgatcgtaatttgggagaaaaactttacttttgtctgcagtgggttgagtgcggtttgttttaagccgcactttttcgtttcattcgcaatgagattttttattttaagaacgtttcataacttcaaaaaattcttcattggtttttgccatcattagcttatcaattaagaattccattgcctcaatttcacccattggattaagaattttacgtagaatccacattttttgtaattcatctggtgtagtcagaagatcttctttccttgtaccagaacgattgaagtcaatagcaggaaatacacgtttttctgcgattttacgggaaagatgcaactccatattcccagttcctttaaattcttcaaaaatcacttcgtccatttttgatccggtatccacaagtgcggtggcaataatggttaaactaccgccttcctcaacattacgggccgcaccaaagaagcgttttgggcgatgcaatgcattggcatctacacctcctgataagatttttccggaagccggtgttaccgtattataagcacgagctaagcgagttatgctatctaataaaataaccacatcttttttatgttcaacggaacgttttgctttttcaatcaccatttctgcaacttgaacatggcgtgctgccggttcatcaaaggttgaagcaatgacttcgccttttactgagcgttgcatttctgttacttcttccggacgttcatcaatcaacaatacaattaactcacattccggatagttatgaataatactttgtgcaatattttgtaacaacatggttttacctgcttttggcggagcgacaattaaaccacgttgtcctttaccgataggggaggctaaatctaaaatacgagcagtcaaatcttccgttgaaccatttccacgctccattctgaggcgtgaatttgcgtgtagtggagttaagttttcaaagagaattttactacgtgatacttctggtttatcgtcattgactcgatcaacttttagcaaggcaaagtaacgctctccttcttttggcggacgaatttttccttcaattttgtcgcccgtttgcaggttgaaacgacgaatctgacttggagaaacatatatgtcatcaggaccggctaagtaagaactatcggcagaacgtaagaaaccgaaaccatcaggtaaaatttctaatatacctcctccaaaaatgtcctctccacttttcgcatgttgttttaaaattgcaaaaataatgtcttgtttgcgtaaacgagctaaattttctaagcccatttgtttttcacctaattctacaagttcagaaacaggtttatttttaagttctgttaaatgcataataaataattgagaatgttataaaaatgaattgataaatgaattgaatgtaaatatgaaattgcgtgcaaatttatcattaaatctttaagttgtctagctatctaacttaaaaatcaataaatgtgcggacattttttgaggattttttccgttcatgttattatcacccaaattctttactgataatttttatgcaaaatagtcatctttcacaacaacgtttttctgatcttgctttacattgtagcgtgcaacaagcgataaaagaaaaaggctttgagttttgtacacctattcaggcattgtctttacctatcaccttaaaagggcaagacatagctgggcaggctcaaaccggcacaggaaaaacgatcgcatttttaaccgctacatttcatcatttactacaaaaaaacaatataaattcctcagaacaaccgagagcgttaattttggcaccgactagagaattggttgtacaaattgcaaatgatgcgaattttctggttcaagcaacagggttgaaaactggcttagcttatggtggtgagggctatgataaacaattaaaggtaattgatcggggtattgatattttaattggcactacagggcgtgtaattgattatgttaagcaaggaattattcgtttagattatattcaagtggtagtgttagatgaagcagatcgaatgtttgatttaggttttattagagatattcgttatttattacgtaaatgtccagtgcctcaacaacgtttaaccatgcttttttctgcaactttgtcttataaggttcgtgaacttgcttttgagcatatgaatgatccacagtatgtagaaattgaacccttacaaaaaacggggcatagaattagagaggagttattttacccttctaatcaagataaaatggcattgttgatgactttattagaagaagaatggccagagcgttgcattattttttctaatactaaacatcgttgtgaggaaatatggggatatttaagtgcggatggtcatcgagtaggattattgaccggtgatgtaatgcagaaaaaacgcttatctttactcaaacaatttacggatggaaccttagatattttggtggcgacagatgtggcagcacgagggttacatattccggatgtgactcatgtgtttaattatgatttacctgatgattgtgaggattatgtacatcgtattggaagaacagggcgagcgggtgaaagcggtatttcaatcagttttgcttgtgaagaatatgcgattaatctgcctgcaattgaagaatatattggtcacagtattcctgtcagtcaatatgatgcgaaagcattgatcgaagatttgccaacacctcatcggattaaacgaggtgcatttgatagccgttcaaatttacaacgtactgtaaagagattgaaaaaaacttattaatttaaccgctcttttatgggatctttgccaagataagcaaatatccctttaattaccggacgataacgttgtacactaatacggaattttcgactaggaaaagagagataaaaatgacaccttatttaattgctccatctatactttctgctaatttagcacgtcttggtgaagatgtagaaaatgtgctaaagagcggtgctgatgtaattcattttgatgtgatggataatcattatgtaccaaatttaacctttgggcctgcgatttgtaaggcattgcgtgattatggaattaaagcacctattgatgtacatttaatggttaaaccggtagatcgtattattcctgattttgctaaagccggtgctgattatattacatttcacccggaagccagtgaacatatcgatcgttctttgcaactgattcgggattgtggttgtaaggctggtcttgtttttaatccagcaacaccattgagttatttagattatgtattggataagattgatgtgattttgcttatgtctgtgaatcccggatttgggggacaagcttttattccaagcacattagaaaagttaaaacaggctcgtaaaattattgatgaaagtggcttggatattcgcttagaggtagacggtggagtaaaagtgaataatattgctgaaattgctcaagctggagccgatatgtttgtggcaggatctgcaatttttgatcagcctgattataaaaaagttattgatgaaatgcgtcagcaactttctacaataagagagaaggaaacaaaatgacacaatttaaattaattggttttgatttagatggtaccttagtaaacagtttgcctgatttagctttatcaattaactctgctttgaaagacgttaatttgccacaagcatcggaaaacttggtgatgacttggattggcaatggtgctgatgttttgagtcaacgtgcagtggattgggcttgtacacaagctgaaaaagagttaacggaagatgagtttaaatattttaaacgtcaatttggcttttattatggcgaaaatctttgtaatatcagtcgattatatccaaatgtgaaagaaaccttagaagcattaaaagcacaaggctacattttagcagtcgtgacgaataaaccaactaaacatgttcagcctattttaactgcttttgggatcgatcatttgtttagtgaaatgctggggggacaatctttaccggaaattaagcctcatccggcacctttctattatttatgtggcaagtttggtctgtatccgaaacaaattctttttgttggcgattcgcaaaatgatatttttgctgctcattctgcgggttgtgctgtggttgggttaacttatggttataactataatattccaattgcacaatcaaaacctgattggatctttgatgattttgctgatattttaaaaattacacaataaggataaaaaatgacaaaaccggttgtattaagtggtgttcagccctcaggtgaattaactattggtaactatttgggtgcgttgcgtcaatgggtaaacatgcaagatgagtatgagtgtttatattgtattgtagatttacatgcaattacagttcgccaagatccggacactttacgtaaagcaacgttagatgtattggctctttatttagcctgtggtattgatccggagaaaagtacgatttttattcaatctcatatacctgaacatacccaattggcatggattttaaattgctacacttactttggtgaaatgagccgaatgactcaatttaaggataaatcagcacgtcatgctgacaatatcaatgtaggtttatttacctatcctgttttaatggcggcagatattttactttatcaagcaaatcaagtacctgttggtgaagatcaacgtcaacatttagaaattacacgtgatattgcacaacgttttaatgctctttatggggaacattttattgtgccagaagcatttattccaaaagcaggtgcacgagtaatgtccttgttggaacctgagaagaaaatgtctaaatcggatgaaaatcgtaataatgtcattggtttgttagaagatcccaaagcagttgtgaagaaaattaagcgagctgtaacagactcagatgaaccgcctgttgtgcgttatgatgtaaaaaataaagcaggtgtatctaatttattagatattttatccggtgtaacaggaaaatctattgtccaattggaagctgaatttgaagggaaaatgtacggacacttgaaaagtgcggtggcagatgaggttgctactatgctgactacattacaagaacgtttctatcatttccgtaacaatgaagaattattaaataaaattgcggctgaaggtgcagaaaaagcccgtaagcgtgcaaaggaaaccttagataaagtttatcgtgcaatgggttttgttactccataaaaacgatttttcccctaagtatttaggggatctttattcttattgtaatacattttcgaaaaaaacagtatttgcagtagggtcacttaatgaaaatagtaagaactttccgaaaaaccgctgttattacaaacctcagaaatctgatacttcgtatagaataagagaaaaatcttctatggcaaaaaatagaaaagcaagcatttcccatgtgacattattagggtgttaaaatccaaggttgtgctaatgaaagagaataaatattagcgatgaaatgagattgttcttctttgggaacggggaagggaataaaggttaatagttcttggtgtaatttcaaaatttttgtaaaacagaccgctctttcgatctctgaaaaaaaatctgggtttaatgctttagccacatatcctctttttattctgcctagtgccatagctaaatgaatgagtaacatgtctacttgtttcgtttttaaatttactcgccattttttaccaagacgatttcggatattaagagtaattgtcataatatcttcatcaattaaatggcgttgaactaaaaaaatcagcctttgctgtattaacatgaatttcattccattacgaaaaggatagtttactttacctgaaataaacacaattaagtagtgcatagatcacaactttgtaggaaaataaacaaaattttacacgataggaattaagatgttaaacaaggaaattatcgcacgatatgaaggattaatttttgatatggatggcacagtaattgatactatgccttgtcataaacaagcttgggagcttgttggtgctgaaatgggctatgctttggatggagatgttatgtatcaattggggggagctccggtaagaactattgccaaagccataatggaaaaagcacaaatgccgttatatttaatggaagatgtgattagtttaaagcgtaaatatggaattgaattaatcatgaaaaatgctactttattgcctgctgcggatattgtgaaacaatatgttggacaaaagcctttagctctcggtacaggttcacatcgttacgtcacggaaatgcttttagagaaatttcaattgcagtcttattttggtgctattgtgacagcggaagacgtgattaatcacaaacctgagccggatacatttttgcgttgtgcagaattattaaatcttgatccgttaaaatgccttgtatttgaagatgcggatttgggcgtacaagccggattagcggcggaaatggatgtttttgacgttcgtgtaaatcaaataattacaagcaagtgattagattttatctgtattttgtgtaatctaaacatttaggcagagtagagaaatagttgccaaccttatttttgattatgtttgtagcttttatttaaaaaatactttataaacataaagttgtgcttttttaatccgttatgattatttcacgtttgctttaactctttaaaaagacccttggttctatttattgtcctttcaatatctaactcagaatatttctcgaaagtaaatagataattgtgatattgctttaaactagtataagctacttttattggcaaaacagttgtttattcatttttcaaaaataaagcttaaagccttgtgctataaggctttaagctggtttttagacaactattttgtctgctttagaatttataatttacatttaaaacaaatgtgcgtccttttgaatagttgtttaaggctttctggtatccatcgcccacgcccatagcataagtcatttggtttgccgagtcgttattcgcatctagcggattaatgtattttttatcaaaggcgttttgaatttcgcctttaatagttaagttttccgttggttggtagatagcgtaaaaatcgaaaattattggctgtgctttgatttcttccgtgccgctaattcttacataagtaagaaatgtctcgccagtctttctagaagtaaaagttcccggcaagataacatcgccatctgctttatcaagtctggctcgtttgcttttaccatagtatttagcagtaccgcctaatgttaattttccgtcaaataaacgtgttcctaggtcaagggaaccgtaatctttcggtagagacgatattttacttaagccgaacccttgtaaatattgtccggtttcactatcatcactcacattataacttgaatcagaaaatgaacttggttgattggttttttgtctggcataagataagttggcatagaaccaaccgatatcataatttaattcaagttccaacccctgaattttaacaataggtgatgaatcagcaggaatgagttggtttgaaggaacttttgtttttccatctcctgtatccaccaagtctgttttcaagattgttttaccgccttcatagttaatatgcgtaagatgttcaacgcagtcataaatagtcggtgctttgtttgatcctctccacgcgtttgaactacattcttgtttgatattgataatataatctctgattttcgtttgatacgctaaaatcttaaagcctagtgcatcaaaatccgagaatatcccatttttataaccgttaatgccgaattgaatggttttggctttttctgattttaaatcgggtcttatggctaatgtaccaaattcggagaaatacatctctttgatattcgggacccgatgggttttggcataactcacaaatggcgaaaagagcgggtgaaaatccgccgagaaagacatagaataattatcatgagatcttgaatctcccttgtggacagagtaaaaacttgggcagttataaacatcccaagtggtatcatcatcattaggaccagtataacaccccaatttttctgctccctcaacaccatacttcgcaactatctctgatgagttggaattgacccaaattggctttccattcttcatttttttatgagagtcatgccatgttctagatgaaaatctatctttaggatcaagagggaaaatcctaccttcgtatttatagatttggcgattggcattgacttttaaggtataaatatcgtatttaaaggtttggtcaaaatagagggttttaaaacgttgttcgccgtcgggttggaatgtattcgatcttatgccgtgatatttacatgcgtttttatacttaccaacctcatcacaagcatcaagtgaattaggttccccaccatcaaaataataacctaattcacgaggatgtcgatttttactgtatttatttttgaggatattggcacctaatgttgcttcataagagaatttttctgtgaatggaatagaaaaatgcatatttatatccgtggttttcgcactatttttgctttccaacacatctttcagcattttaccattaaacacgcttcccttgtgataggtttgcgtagaggtattatccgccaagattaattcaaattgtaaattctctttcggttttagttggtagtttaactggtagtttttattctctaaatttctgccggaaagtgcggtcgataaagagcggtatgataggatagctttattatatttatcgttatattcgattttggctaaatggctttggggatagtggagtaatttgcttgggtcatagggttgtaatccatagagttttcgtttttcatttctgtcacaaaatgcttcgcctttacaggcttcttcaactattcttcccacttcttcagcgtcaacatcttttatacttctacccccccccactttaaaatcttgcgagcttttacgccaactataggcatacataaaacctaatgttcttgtatcggaaaaaggatagcgaaaggcaactgcacccatataattcggtccggttgcattggttcctccgccaacatttaataaagcacctacatttctgccttcacttattacgtcatcaacaccgattgttctaaaatttgccgaacctactagagcattagcccccgctttaccgtcaaaacttcctcgttgaatatctacactggtaataaacgcagggtcaatggttgcaccgaattgagaggttccaccggctttttcgctgttatctcctgatgtggcaaaaaaggtttgggaaataccgtccaccatcgtattcacccgtccaaatcccgtttgaccacgaacgttcaccgacactgtccccgaacttttatcaaggttggtaaacgcacccggtaccgttctgatgatgtcatcaatagactgcgttgacgtggaaatattttctctcacactggtcgcccccgcttttttaaagacttcctgtttaggtggtagcttatattctacgttaatttgatcgagcatttcttctgcataaacacacgtgcttaatacggaaaaagctaccgcagtgagtttaaatttattagtcatcatttttatcctagttatttatgattaaattcatggtgtaaacatgtacgaccagttatataaaaatatcctgtgcatgtcaattaatgataataatttttattattatttttagtttatgcggaaattcagcatgttatcaaaattgatattcgccagcctgaaagctagagtttggctctggcggaaaacatgctttagttaaaaatgattcggaggaaatgcggtctattttttacaaagatttatctttaataaaaggaaactgaatgcgatattttatcgccagcattctgatgagtgtacaggttataattgccagccatggacttagtaggggagaaattaagcctgtcgaacctaatagttctatggttgcaccgacaatggctgcacctgcatatatttcagattgaaaaattaacggcgatttgtttgtcaatacatctcggatacagccaccacccaccgcactaatacaacccaaaataatagataattggatattttccgtcatataccacgttttattcgccccgaacgctgcaaaaaaacctaatccaacggcatcaagtaagttgctcacctttgagaacgacgttattttttcttgaaaaaaagatacgcaacacacggctaaaaggataattaatagataggcgatattttccaagcctgccggcggtgttgctgataggcataaatctcgaataattccaccgcctatcgctgttactgctgagacaacaaaaacaccaaataaatcaaattgtttcttcacgccagcaaccgcaccacttaaggcaaagataaatgtaccgagaagatcaatgaaattaaatacggataacataaaataccttaatcttaattttaaagcatcattctagcataacgaaattaaaaaaaaacttcgcagatgtaatggacacaaaaggattctatacattaatgaagcaaagtgtacatttgtacattacatcagcatagttgttatggtaatctagaagaacaaagtgtgttgaaaaaagagattcttggcgtaatgccgattttaatatttaaacgaaatatcctaagttatggtgaagaatatgataagtaatttaaccgaacagccttctggtgctgagtaccttaaagcaattttaagttcaaaaatttacgaacttgcacaggttacacccttacaacctatgctcaaactttctgagcgtttaagtaataccgttttagttaaacgtgaagatcgccaattagttcatagctttaaattgcgtggtgcttatgccatgattgccggtcttagccaaccgcaaaaaaatgccggtgtgattaccgcttccgcaggaaatcatgctcaaggtgtcgcactgtcagcgaaaaatctgggattaaacgcattgattgttatgccgcaaaataccccccgcattaaagtagatgcagtgcgtggttatggtggcgaagtgcttttatatggtgcaaactttgatgaggcaaaagcaaaagcgatagagctttctgaaagtaaaagtatgacatttattccgccttttgatcacccggcagttattgcaggtcaaggttctttagccatggaattattgcagcaaaacagtcatattgatcgtatttttgttcctgttggcggcggcggattagcagctggcgtggctgttttaattaaacaattaatgcctgacattaaagtgattgcggtagaaagtaaagattcagcttgtttacacgccgctttgaaagttggtcaaccggtagatttagagcgtgtcgggttgtttgctgacggtgtggcggtaaaacgtatcggtaatgaaactttccgtgtatgtcaacaatatattgatgatgttgtacttgttgacagcgatgaagtgtgtgcggcaatgaaagatatgtttgaaaatgtgcgtgctattgcagagccatccggtgccgtatcattagccggcttaaaaaaatatgtgaaagaacataatattcaaggtgaaacgttggttaatattttgtccggtgcaaatttaaattttcatacattgcgttatgtgtcagaacgctgtgaaatcggtgaaaaacacgaagcaatttttgctgtaactatccctgaagaaaaaggtagtttcctacgtttttgccatctgttaggtgatcgtcctgttaccgaatttaactatcgttatgctgataaagaacaagcctgtatttttgttggggttcgtattagtagtgaaaaagaaaaattagaaattattcaacaacttgaacaaaatgattataaagttatggatctctctgatgatgaaatagcgaaaacccatattcgctatatgattggaggacgaacaaccagcaatagcaaagagcggttatatagcttcgagtttcccgagcaaaaaggcgcattattaaaattcttgatgatgttaggtacgcattggaatatttctcttttccattatcgtgcttatggtgcagactatggtaacgttttggcaggctttcagttagatgaacatgatgaaattcggttcaatggtcatttagaagaacttgcttatacttatcaagatgtaacggacagccccgcttacaaatatttcttagcttgatgcacgataaaatcaaaaaatgccatactgaatggcattttttctactcaacttctttaattcgcaactctttcggcacttcaaaaacggtattttcttcgcaaccttcaagttcttccactttatcaacacctaattcttttaaacgggaaatcaccgattgaaccaatatttccggagctgaagcaccagctgttaaaccaataactgtaacattatccaaccaacttacctcaatatcatttgcatcatcaattaatttcgccgtaacacccattcttgaggcaagttcagccagtcgattggaattagatgagtttttagaacctaccacaataactaaatcggacagtttggctaattcacgaactgcttgttgtcgattggttgttgcatagcaaatatcatttttgcgaggaccttgaatggcgggatatttttgttttagcacctcaattacaccggcagtatcatcaattgataatgtggtttgtgtcataaacgtgatgtcttcatcattccgtaaagtcagtttggcaatatcttccacatcttctactaaataaataccgcccttatcgttatcatattgtcccattgtgccaatcacttcggggtgtccttcatgcccaatgagaatggcttttgttcctttacgactggcacgagcaacctgcatatgcacttttgtaaccaaaggacaagtggcatcaaatacttttaaattccgctctttagcctcttgacgaacagcttgcgaaacaccgtgtgcagaaaaaattacaatagcaccattaggtacttcatctaattcttccacaaaaattgccccacgctcacgcaatccattcacaacaaaacgattatgtacaacctcatgacgcacataaataggtgcaccgtgaatttctaatgcaagctccacgatactaatagctcgatcaacaccggcacaaaagcctctgggattagccaaaataattttcattagttttgcttactctcttttttatcgttttgcttaaaagcatcaatagccaataatccggcaccgatacaaattgcaatgtcggctacattaaacacagggtaatgccattgttgccaataaaaatcaaaaaaatccactacaaagccatgataagctctatccgccgcgtttgccaaagctccaccaatcattaacgcatagcctgtattttgtagtttctgtgttgcttgatttttatataagaaaaataaaatcatgaaggaaaccgctaaagccaataaaataaaaaagtatttttgccaacctgcatggtcagccaaaaagctaaatgccgccccgtgattacgcacgtaagttaaattaaagaaaggtaaaatgttaacactttcgtataaagaaaaattttttactacagcgagttttgttattaaatcagtaaaaaaagcaaccgcacttatccaaagaaatggaagtcctgtttttgataaattcatatggtttccaatagacgaaaaacgggcgtaatataacacccaatttaaattatcttgcgattaaacgctcgtgcgttctgtttcgcaggatctactttgatagccgttattgtaaaatcttaaacatctctctaacggcagaaggattatatcttactttataccttatatccacgctctgaaagacggagatttacggcacgttgcgataaaattaaattctatgtgagtttagttcgattattctgttgtattttaaccgctcttttccagcaaaattgaataaattagaggataaaatttatttacttatattgccattgtttggaattttctctagaatttgagaaattttaaccccaaaacagataggtaatacaaaaatgaagaaaaaaatcacttttactaaatctctcatcgcttcagcgttggcattatcagcgagttatgtcaatgcgtctgctttccaactcgccgaggtatccagttccggtttggggcgtgcttatgcaggtgaagcggcaattgctgataatgccgccgttgtagcaaccaaccctgcattaatgagtttgtttaaagcgaaacaattctcatggggggggggtatacgttgattccaacattaatgtaaacggaaaaatagacgttagcacatcaccaattccttcttctcctgatattctaaatgttaaagccaatcaaaaaaatatcgtcccgaatacccttattcccaatctgtattttgtaacccctattaatgataaatttgccatcggtgcaggcatgaatatgaactttagtttgagaagtaaatataaagatgattatgttggcggtgttttgggtggaacaagcgagatggattctattaatttgaatttaagcggttcatatcgtgtcagcaaaggattaagcgttggtgcaggattaaatgccatttatgccaaagcgaaatttgaacgccgtgcagggattttaaagaaaactattgatagtttacgtagtgatgacaatgagctgcttattttactctctccatcaatagtatcatcggcatatagcctaacatttcatgaaaacagtactgtagcacgcttacaagataacaatgcatggggattgggttggaatatcggtgcggtttatgaatttaatcaagataatcgtatcggtattgcctaccattctaaagtagatattgattttaaagataatgatacattgggttatatacttggcaaagaagagattaagcttcatcgtgcaaaaggtaagttaactttacatttaccgagctatttcgaaatttccggtttccaccaattaacagcaaaatttgctatgcactacagctataaatatacgcaatggagccgtttacaaagtttgcatgccgcttattccaatggtgaagtcgcttttcataaagatgaaaactttcatgacagttctcgtgtagctttaggggcaacttatgatgtgaatgataaattaactttacgtgcaggtattgcttatgatgaatccgccgaccacccaactgcttccattccggataccgaccgcacttggtacagcttaggggcaacctatcatttcacaccaaatctttctgtcgacatgggctttgctcatttacgcggtaaaaaacagaaatttaaagagaaccactcatttacaagcaaagataattatgaagtaggtagaatagatgcagattatcaatcaacagcacgagccaatctgtatggcttaaatcttaactaccgtttctaacgattatccaattgtttattagttatagaaggcgtattttgatacgcctttttattttttactcaaaacatcataaaatcttaaatgagtaatctaataaatatgtcaagttgcgattttaggaaaatgtcagtattcaatatcaatcaggcaaattgacgttgctctccgttaccttctacgttttcgatacaacgcccgcaaatgtgagaatgttccttatttgatccgatgtctgtagaaaagtgccagcaacgagggcatttttccccatcggcacgttccacttttatcgctaagcctgtcaattcgctttcagctacatcggctttcgacaacggtttcactacgacttgtgaggtaatcaacacaaagcgtaactcattaccgagttgttccagtaatggacgaatttcctcgcttgcatagacggtgactttagcttcaagtcctgctccaattaatttgtcgttacgtgcttgttctaatacacggttcacttcggcacgtacttttaataactgttgccagtaagtatcgtccaatttatcgctttcatctaacccaaacaaaccatcataaaattcctcggtaaagacaaattcagcacgattatccagttttggcaagtagccccaaatttcatcagcagtaaaagataaaatcggtgcaatccaacgcacaagagcttctgaaatatgccataatgccgtttggcaactgcgacgagcaaggctatccgccttagttgtatactggcgatctttgataatatccaaataaaatgatcccatctcaattgaacaaaaacgcattaagcgttgtacaactgtgtggaattgatagttatcataagcttctttgatttcgttttgtgcttctaaagcacaacttactgcccagcgatcaagagaaatcatttcttcagggttaactaggtcgttttttggatcaaatccgtttagatttgctagtaaaaaacgagcagtgttacggatacggcggtaagtgtcgcctgcactgtttaagattttgtgtgaaacggcaatttctcctgtgtaatcggtggacgctacccataaacgtaaaatatccgccccgtttttgttccaaacttcacttggcacaataacattaccgagagatttggacattttccgacctttttcatccaccgtaaaaccatgggtaagtacttgcttataaggtgccttattgttagttgcagtagataacatcaacgaagacataaaccagccacgatgttggtctgacccttctaaatacatatccgtagatttaccgttaaattcagggcgttgctctaccacggaagcataagttgatcccgagtcaaaccacacgtcaagcgtatccggcactttatgataagtttttgcatcttcacccagtaattccgcaggatcaagatcccaccaagcctgaatacccgctttctcaacacgttttgctatgtcttcaagtaattctaaagtgcgagggtgtaactcttccgtttcattatgcacgaacatagtcatcggtaccccccaagtacgttggcgagaaatacaccagtccggacggtttgctaccattttatcaatgcgagcttccccccaactaggaatccaacgcacagatttaatttcgcttaatgcttttatacgcaaatcttgcgtttccataccgataaaccattgtggtgtagctcggaaaataatgggtgttttgtgtcgccagcagtgtggatagctatgtttaatacgttccaatttaagcaatgcacccgtttctttcaatttttccaataccaaatcattggcttcaaatacgcctttaccggcaaagaatggcgttgaagaaatgaatttaccgtcatttgccaccaacccagccatttccaaaccatatttttttgataccacaaagtcatcttgaccgtgatccggagcggtatgaactaaacctgtacccccatcaacggtaacgtgatcgcctagaataataggaacagaaaaatcgtaaaacgggtgatgaaaacgaacaagttctaaatcttgacctgttgtcgaacctaaaatttccagctgttcaatttttaacgcattttgtaccgcttgtactaattccgccgccaaaattacacgctcatcaccaagttgaacaagctgatattccaattctgcattcactgcaatcgcacggttagacggtaatgtccaaggtgttgtcgtccaaatgaccgcagacaatgcaccttgacctttaccaagtgcattgaatttttcttcaacctccgccgcacttaccgccgcaaaacgcacatagattgatggcgaaactttgtcttcatattccacttccgcttcagccagtgatgaagcacaatctaagcaccaatgaacaggttttgaacctttgtaaaggtgaccattttgaatcactttacctaaagtgcggataatttctgcttcagtttcaaaattcattgtaagataaggattatcccaatctcccagtacgcccatacggataaagtccgctttttgaccttcaacttgttcttttgcataatcacgacaagcctgacgaaactctgctgctgaaattttctcgttcggcttacctaccaaaccttctacttttaactcaatcggtaaaccatgacaatcccaacccggcacataaggtgtatcaaagccaagtgcggtcttagatttcataataatgtctttcaaaattttattgacggcatgaccaaggtgaagtgtaccgtttgcataaggaggtccgtcgtgcaaaataaaggttttcttacctttcgaggcttctcgcactttttggtataaatttttatcataccagttcttcaacatatctggctcacgtttagccaaatcacctcgcattggaaaacccgtttcagggagatttagagtgtttttgtagtctgtcatattaattatttctcaactttataatgaatccaagattgttttcgcactggaatacacaaggataacccattgatttaccgaatttactaaacgaatttgtccattcagaaattcaaccatccaataatcctcaaaattaatatctgtagtattaatattgcattcttcatttgaccgagcataatctgcaccgcatactacttttgtcggcggaccatacttttggggcaatccatttaaaatatctttcacttcttgtacttcacgtgggaagggcggtctgttttggctataattcaaaatatcaattgcaatactgttcaatacttgtccattaaaataagcggttgcttctcgattattgccgttaaataaaaaatgctgacatttataagaatttaatggctggtaatattcccaaccggtgcataatttagagtcggcaatttgttgataggtcatgccgaatttaagatctttataaccgtctaaaatgatattttgggcaaaactcaagcacggaataaatgtacccaaaaccagcaacaaattttttaactttttcatgaaatgtcctaacagaatttcttgcattaacataatttatttgcaacaagaaaataagcaaaagcgatttagcattatacgcataaatccttaacggtcaaaggttcaagacttgctgaaaatacttttttgccacaacaacatcattttcaatctgatttttaagggcatttagagaaggaaattttttttcatggcgaattttatggcaaaattcaatttgcaaggattgaccatacaaatcacgatcaaagttaaacaaatgcacttccaataattgttttacgccattgatagtaggtcgcttgccaatgttggcaactccttgaaaaatatcgccattttttaaccgcacttttacaacgtatacacctttaattggattaacttgccgatgtaaataaatgtttgcagtgggaaaaccaatagttcgtcctaatttattgccatgagcaactcgtccataaatacgatatggcttacccagtaacttttctgccaacgctaaattatcttctgataaggcttggcgaatggcggtgctactaatacgccggtcatttaattgtaaacttcgattatcttccactataaagctttgttgttgcccttttttttgcagaagtcgaaagtcgccttctcgatttaaaccaaaccgaaagtcatcaccaatgcttaaaaacttcatcttcagatgtttcactaaacaatctgaaataaattgctccgcacttaattgggcaaaagtgcggttgaatttaacgcagaaaacataatctacacctaactgtgccagataggcgagtttatctcgtaaacgcataagccttgccggtgcctgatcaccttgaaaatactcataaggctgaggttcaaataacatcactacaacgggcaaattcagctgttttgctttcgcttttaaatgttgcaaaatagattgatgccctaaatgaacaccatcaaaattaccaatagttacagcacaaccctgctgttttaaaggctcgggtaaattatgaaaaccacgaataagttgcataacatcgcctaaaaataaaaatttcttgaaaattgtcgcacattatacgtataaatatacaatggtaaaagaatgcagcataagcttactttctgtttaaaattagaaaacgacaagcataaggatttttctcatctgccggacgttgttgctcaaattcaatctgccattcctgccaattaaattcaggaaagaaagtatctccctcaagttctgtttgaatctccgttaaatataatttatttgcttgaggaaggtattgcttaaataattcgcccccgccaatcaacataatttcatgatgattttctcgcacaaaatctaccgcactttgtagattgtctttccaaataatgccatcgtgttcataaggcgaacgggaaagtacaatattggttctattcggtaagggacgaccgatactttcaaaggtttttcgccccataatgatgggttttccgccagtattttgacgaaaccaagcaagatcagctggcaaatgccaaggcatttgattatttttgccaatcacatgattttttgtcatagcaacaattacacttagtttcatttactttccttcttccttatcaaaaatcaaaaaagtttatcagcgagagtgactatactacaggtttgtgtcgataaaacaataagcctggtaatgctaggccaaaaacaagtgctccaatgaggaaacctgttttgagaaaatattccgtcatttgtgctacacgttgttcattgaaaccataatgatgcaaatgaacaattgcgatcatggctttataagcgaaaacgcctgggatcattggaataaccgctgcgacagtaaaaactttcgggtgagccaaataacgatgcgataaatatacgccaataaacccaaccacactggcagctataaaagtcgcaaaaactaaaggaatatcgaaatgtactaagaaagttcttgtcccatgccccaatgcccccaaaaatgcacaatattttaaaatattcttaggtacattaaacactaaagcaaatccgacggcaggaatagctgcaaaaaacatatcatctaataactttaagataaggtccatgattaacgcccccaatcggcaatatgtaaaaaacttagtgcaaatacaattcctaaacaagtaccaaaagttaatactgttgccaaagtccaacgtgcaattcccatattaatatgtccttttagaatatcggcaagcgaattaatcaatggaaaccccggtaccaataacaatacacttgatgctaaggctatttgcggatcattacctaattcatatttaacagccaaacccgccaccatagaggcaacaaaagcggttatagcaaaaacaatcaaaggattataatgacgcaaagttaaagtttgacgaataaacatagcgatagatgaggcgataaatgtgattaaaaaaacgattatatctccaccagataaatgggcaaagcaagcacaggacaatccgatcatagtaacaactacaaaacgattgtattttaaaggcttaataccatctaattttttgcgaatctgttgcagatcatatagtcctttttctgccataattaccaagcgttgtacctctgttaccacttgcatattaatgcctttatcaaggtttttgcgtaccgtagtaatgcaattgtgatcatataatgtagtaataatgacggcattgggtgtcagtgcacattccacactatctattcccaatgcaaaacctaaacgttgtgccatttgtacaatcaatgtactttctgcaccatgctgtaataacatctgtgcaacttgtgcacaagttcttgttatttctcgttgtcgaaatgagctattatcctctgtagtattcataaaaacacctcattctattaaaaaagatgaccgcacttattatatgcttttcttctgtatcaattttgttttaaatcataaaacagcaatgaaaatcgcatgatttttcctaactttaatggtaacttatggggaaatttttcaagtaaagacaactatggaaacacaaaaaacaaataaaaccattgtggtaaaatttggtaccagcaccttaacgcaaggttcatcaaaattaaatcgccctcacatgatggaaattgtgcgtcaaatcacacagttgcatcgagcaggctttcgtataattattgttacctccggagcgatggcagcggggcgacattatctcaatcatccgcaacttcctccagcaattgcctcaaagcaattactagcagcagtaggacaaagtcaactcattcaaacgtgggaacaacttttcgctatttatgatattcatattgggcaaattctgttaactcgagcggacattgaagatcgtgaacgttttatgaacgcaagagatacgttacatgctttattagataaccgaattattccggtaatcaatgaaaatgatgcggttgcaaccgctgaaattaaagtgggggataatgacaacctttctgcattagtggctattttggcacaagcggaacaactctacttgctaacagatcaacgtggattatttgatagtgatccaagaaaaaatcctcaagcaaaactgatttccatagtcgataaaattactgatcatatccgctctattgcaggaggaagtgggacaacgttagggacgggaggaatgacaacaaaaattagtgctgctgacatagcgactcgttccggtgttgaaaccattattgcaccgggtaatcttgaaaatgtcatcgtcaatttggcttatggaaaagaaatcggcacaaaatttgttgtgcagacagattgcttggaaagccgtaaacagtggctctttgctgcaccggttgcaggtatagtaactattgatgagggagcggaaagtgcggtattgattcagcataaatctctattacctgcaggtattatcagcgttgaaggatgtttttctcgtggtgaagttgttaaaatttgtggcacgaacggtaaaaaaattgctttgggcgtacctcgctataacagcgattctctcatacaaataaaaggaaaaaaatcgcaagacattgaacagatcctcggttatgaatatggttctgttgctattcatcgtgatgatatggtcgtttattaatcagaaagtttttatcctgataaaataacaaccagcttgtcaaaagaatgtgtttagactactaaatgaagagcaaagacttcatatactcttgaagtcatatatgaataaaaacccggcaaatgccggggttggaaaagagatataaagttaaaagaacttaaccgtttgctttctcaacttgactgaattcgagttcaaccggagttgctcgaccaaagattaaaacagaaactttaagacgccctttgtcgtagtccacttcttcaaccgtaccattgaaatcggcaaacggtccttcagtaacacgaatttcttcaccgggttgaaactctttgcggtgacgaggcttatctgcagtttcttgtacacgattaagaatacgctcggcttctttttgtgaaataggtgccggtttatctggtgttccaccgataaatcccatcactcgtggaacactgcggactaactgccaagtatagtcattcatttccatttgaactaaaacataacctgggaaatatttacgctcacttttacgacgtttaccaccaacattttcaactacttcttctgttggaactaatacttcaccaaactgttcttccatttgatgtaatttaatatattctcgtaatgtcgcagcaacacgaccttcaaaaccggaaaatgcttgaaggacataccagcgttttttggctgtattttctgtcatattagaaccttaaatccgttaaaaatgtaattaatgaaacgataactgaatccaatccccataaaattaatgatgctattacagtcacagcaaatacaattaatgttgtttgcattgcctcagggcgagtaggccatgtgattcgtctcagctcaatacgagaatcggaaaaaaatcttctggctttcataccttgattagtaatagcggcgatacctaaagcaataagtaaagcaacaacaatacccacaacacgaagagctgttgaaaatttttctactaagtaaatattacttacagccgccacaataacaatagcaaccactaacaaccataaaaagccattcagacctttcgatttctgctcaatttccggagccactttattttttgtaatttctaatgccataaattagtccatcatttaattttatactggaatcctatttgaacgagcaattctagcactttcttattttattgcctatcaaaaaatataaattacgtgctatttttaatcttaatgaaaaagggatctataagatcccttttctgtcgaaacctatacaaataggagttcggtattacttaataatcttagcaacaacacccgcacctacagtacgtccaccttcacgaatcgcaaaacgtaaaccttggtccatcgcaatcgggtgaattaagcttactgtcattttgatgttatcgccaggcatgaccatttcaacaccttccggtaattcaattgtaccagttacgtcagtagtacggaaatagaattgtggacggtaacctttgaagaatggtgtatgacgtcccccttcctcttttgacaacacataaacttctgattcaaagtctgtgtgcggtgtaattgaacccggtttcgctaatacttgaccacgttcaatttcttcacgttttgttccacgtaataacgctccaatgttttctcccgcacgaccttcgtctaataatttacggaacatttctacacccgttactgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagangctaattcaagaattttttcttcccactcagcaactccatttaatgcttgtaatgctgaaccacgtacaattggtgtgtcatcgcccgggaagtcgtattgrgaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcrtgtcccggacagtcaacgtgtgcgtagtgacgtgtcgctgtatcatattcaacgtgtgaagtgttgatagtgataccacgtgctttctcttccggtgcgttatcaatttggtcaaatgcacgtgccgcaccaccaaagtgtttggataatacagtcgtgattgctgctgttaaagttgttttaccgtggtcaacgtggccgattgtacccacgtttacgtgcggttttgtacgttcaaatttttctttagacattgagagtccctctaaaaaacacggttatcgatggtacaataacaccacattaacctaatgtatgatttacggtttaattaaaaggatagttgaaacaagaagtggtgctgataggcggatttgaaccgccgacctcacccttaccaagggtgcgctctaccaactgagctatatcagcgcctggagcgggcagcgggaatcgaacccgcatcatcagcttggaaggctgaggtaatagccattatacgatgcccgcagtccataattcaactgtcccatcagaattcattattaagaatggtggagggagaaggattcgaaccttcgaaggctgagccggcagatttacagtctgctccctttggccgctcgggaatccctccacgcaaaaatgaatacttgtttactttagaatggtgccgactaccggaatcgaactggtgacctactgattacaagtcagttgctctacctactgagctaagtcggcatcgtaagcaagtgaggcgtattatatggaaaaaattacccctgacaagtcttttttcgaaaaaaaaacactttttttattattcgattaataatcaggcaaaatatataaaaattgtgaaaaaaacagttgatttagtctctttccagatacttgttttagcatttataatgtatatttttatctctttctgtcattttaagtagaatttatcgtggaagaactcaacactattaaactttctgaccacttaacgccttttttaacttttaatcggcaacagtgggctgaattgcgaaaatcagtacctttgaaactaacagagcaggatttgaagccgctattgggttttaatgaggagctttctttagaggaggtgagtacaatttacttacctcttgctcgtctgattaattactatatagaggaaaatttacgacggcagactgtcctcaaacgttttctcagcgggcataatcctaaagtaccttatatcattagtattgcaggtagtgtgtcggtgggtaaaagtacatcagcccgaattctacaatcgctattggccaattggcccgttgcaagaaaggtagacttaattaccactgatggatttttatatccactagaaatattacagaagaaaaatttgttgcaaaaaaaagggttccctatttcgtatgatactcagcgattaattcgttttttagctgatattaaatcgggtaaaaaaaatgttaaagcaccaatttattctcatttaacctacgacattatacccaaccaatttgatattgttgatcgtccggatattttaattttagaaggtcttaatgttttgcaaattgggtctaataaatcaaatcaaatgttcgtatctgattttgttgatttttcaatttttgttgatgcagaggaggagcaattaaaagaatggtatataaaacgctttttaaaattttgtcgcagtgcttttacagatccgaattcttactttaaacattatgccaacttatctgaacaggaagccatcgaaaccgcaactcaaatttgggataatattaatggcttaaatttgaaacaaaatattttaccgacaagagaacgagcgaatttaatcctaaaaaaaggagaaaaccacaaagttgaattggtcaaacttaggaaataaataaaaaataccgcacttttttaaaaagtgcggtatttttatccatattttaattaatgtaaaacatcaacaatatttaaaaagatgtttaatgctacgctatttaacagatcgataaagaatgcaccaaccataggcacaattaaaaacgctttgtgagacggtccgaaatgagaggtaactgcttgcatattcgcaacggctgttggtgtcgctcccaagccgaaaccacaatgccctgcacttaatacaacggcatcataatcacgtcccatcatgcgataagtcacaaaaatagaataggcagccattaccacaacctgtgctaacagtacgactaaaattggtaatgctaatccagccaattcccaaagttttaaagacatcaatgcgatagctaaaaatagtgataaacccactgtacctaacacatcaattgcctcatccgctactttgaacttcacaacatgagcgagtgcattacgaattaccgtaccggtaaataaacaccaaacaaacgtcggtaattgaagtgcggttccttttgtaagcacatctaaatattgcccgacaatcagacacacggacatcatcgtaatggtttcaataattgaacgagtattgattttgcgacgatatacgggcttttcaaatacctcttctatatcgtccacattttcatcttccagtacttccgctttatgcaagcgtttcaataagaatctggctaccggtccaccgataatccccccgaaaaccaaaccgaatgtcgcacaagccattgccagttccaatgccccttgaatgccaaaacgattacttaaagtttctgcccaagcagctcctgtaccatgaccacccgttaatgtaacggagcctgcgattaacccgtaagcaggatctaaaccaacaagcatagaggttccgataccgactgtattttgtagaataattaaaccaagtgcggcgaataaaaagataacgagaggtttaccgcctttcgctagacgagcaaagttggcacttagaccaattgagctaaagaacactaacatcattgtagtctgtaatttagtatcaaaactaaaactcatatcccaaaagtgatgcacaatgcttaagataatagccacaataaagccaccaaccaccggctccggaatattgtattcgctcaagaaatgtacacgtttcactaaaaaatagcccagtaataaaaccaagcaggctaatgccactgtttcataagtaccaaaagtcatattaacccctttttttgattgttgttcctgtatatattattaaatcagatactaggataggaaaaattagcaaaatatttttgcaaattcagcaaggctgtggaacgtaacaaaaaaaagcatttttgtctagtaaattgcttctttatgtatcagtaaaagtaaaatttggtagatctatttagtcaaattcaagctcaaccgcattttctcctaacattgttaccagtgcactcaataactcatctgttggataaacagaccattgcacaccgaagcgtatcaaagctcgtccgtctttactttgatagtaaagatgtattggcaaagaaccgccgctaaaaggttcaataattcctttgagttggcgaataaagtgcggtgttatttgctcttgggataagctgatggctaaattttttgcataacgactacgagcttcatctaaagtcattaactctcgtacagacatttttagcccttgagaaaaatcatcaaaactgactgtaccggaaacaataacaacggtgtccttctgtaatttatcaccaaaacgttctaaagcatcagcaaacaacgttatatctaaaagcccggaacggtcatctaaagttgcaatacctaatcggtttccttttttcgtcactgcaaatcttaatgctacaattaaaccgcaaacagtacttattttgcctcgagtgtttggagataactcatttaaacgtgtcgaactgtaatgagacaactcttttaaataacgagtaatcggatgactgcttaaatacaaacctaatgtttcacgctcaccgtctaaaatttgtttctcgctccaacgtggcgtgtgtgcataagcggtttcaacatcttcatggcttgaagttagtacaccaaacatatcaacctgtcctatcgcctcatcttttgcatgctgatccgatgctttcaacgcatcttccaaattttgggcaagtgcggctcgatgtggacccaatttatcaaacgcaccggatttaattagattttcaaaggtgcgacgattaatctgttttaaatctactctcgcacaaagatcgaataaatctttaaaaattccgccttgttcacgggctgaaactattgcatttattgggacttctccaacgccttttatcgcaccaataccataaacaatttcaccattatcattcacactaaaatgatgtttgcctgtattaatatcagggggaacaatagtgagacccatacgtaaacactcatcataaaagctcacgatcttgtctgtgttatccatctctgaggtcatcaccgctgccataaattcagcgggataatgtgtttttaaccaaagggtttgataagaaaccaaagcataagcggcagaatgagatttattaaaaccataaccggcgaatttttccactaagtcaaagattttcatggctaaatcgccatcaatcccttttgctatcgcacctttttcaaaaatatctcgttgtgccgccatttcttcaggttttttcttacccatcgctctacgcaataaatccgcaccgccaaggctgtatcccgccagtacttgtgcaatttgcatgacttgttcttgataaacgataaccccataggtaggttctaaaatcggcttaagggattcatgttgatacttaacatcaggataagaaacaggttccactccgtgtttacgatcgataaagttttgcaccattccagactctaaaggaccggggcggaataatgctacaagtgcaataatatcctcaaaacagtcgggctgaagtttcttgataagctctttcattcccctcgactccagctggaagactgctgtggtttcagcttttttcaacaagttaaatgaatcgggatcatttaaaggaattgtcgaaatatctaccgcacttttaccctctttaactaaacgagcgttaatcatatccaatgcccatttaataatggtcagcgtgcgtaagcctaaaaagtcaaatttcactaatcctgcatattcaacatcatttttatcaaaatgtgtaacaggatgtttcccttccgagtcgcaatatagaggtgagaaatctgtaattaaactaggagaaataactacaccacccgcatgtttacccgcattacgtgttactccctccaattttcttgccatatcaattaaggctttcacttcttcatcattgttataaatttcggataatctcggttctacctcaaaagcctttgtcaaggtcatacctggatcggcgggaattaatttagcaatacgatccacaaaaccataagggtgtcccaatacacgccccacatcacgaataaccgcttttgccgccattgttccaaatgtgatgatttgcgaaaccgctccacgcccataagtttctgcaacatgctcaatcacacgatctcgcttgtccatacagaaatccacatcaaaatccggcatagaaacacgttcaggattgagaaaacgctcaaaaagcaaatcaaattcaagaggatccaaatcggtaatttttaacgcataggcgactaaagaacctgctccggaaccacgtcctggtcctacaggaatatcattatcttttgaccactgaataaactccatcacgatcaaaaaataaccgggaaagcccattttattaatgacatccagttcggtttgtaagcgatcatcgtattctttacgtttttctgaccgcacttgcggatcaggaaacagggtctgcaaacgctcctctaatccttctttcgatttttggattaaaaaatcttccggacttaagtcacccgttggaaatttcggtaaaaaataagtccccaaacgaatggtgacattacaacgttgtgctattaatacagtattttcaagtgcggtaggaatatcagcaaacagctcacacatttcttgctccgagcggaaatattgttgtgaactgtataatttcgggcgtttcggatcatccagtgtataaccatcatggatagccactcgaatttcatgtgcctcaaaatcctccggacttaaaaaacacacatcatttgttgctactaaaggtaattgtttttgctgtgcaagtattaaagcagattgaatatagcgatcttcatcggatcgaccggtgcgacttaaacttaaataaaagtggtcgggaaaatattcttgataaaaagctaccgcagtttccacatcaacagaattatttttcagtaattttttccctacatcgccattgcgaccaccggataaaatgataattccctcatgatgttctgccaaccaagactgatcaatgtaaggtaaattataataaccacgttcataagccttcgaaagtaataaggtaatattatgataaccctcgttatttttggctaataacgtcagttcaaaaagttcatctcccaacaaatcacttttcacgagaacatcagcaccgataataggtttaacgcctgaggattgtgcttcaccataaaaacgaactaagccacaaaagttagtaaaatcagtcaatgccattgccaccatttcatgttgcacacaggcttttatcaaaggttttaccttagtaatgccgttaatcatggaaaaatcactgtgtacacgcaaatgtacaaaacgaggctgtgacataaaaaatcctataaaaataatttgagggaaaaagtgcggtgtattttagcgatatttctcaacaagctcaatcaaaggcaaaggacaaaaattccagcaaattattaccgcactttgaaaaaaagaaacccgactaagcgtcgggtttaatttagctaaaatgaactactgttttgcaacaaccttcccatcaacataatccacaatgacttttttacccggtaataattgtccggataagatttgttgtgctaatggattttcaatttcttgttgaatggcacgttttaacggtcttgcaccgtaaatcacatcgtagccgacttcaccgataaaatctaaagttgcatcggtaaattcaagctgataaccatgggtttccatacgtttcactaagcgttgtaattgaatagtggcaatggcacgaatattttctttagctaatggatggaataccactgtttcatcaatacggttgatgaattcaggtcggaaatgttgccctacaacggacataacaacttctttcatagcattataatccaactctttattgccttgaattaaatcagagcctaaatttgaagtcataatcactacagtattacgaaaatcaaccgttctgccctgtccatcggttaaacgtccgtcatctaacacttgcaataaaatattaaagacatcgctatgggctttttctacttcatcaagcaaaattacggaatacggacggcgacgaacggcttcggttaaataaccaccttcttcataaccaacatagcccggaggtgctcccactaaacgtgaaacgctatgtttttccataaactcagacatatcaatacgcaccatggcattttcatcatcaaacataaagttagcaaaggttttacaaagttcggttttccctacgcccgttggtcctaagaacaagaatgagccaataggacgatttggatcagataatccggcacgactacgacgaatagcatttgcgacagcaacaaccgcctctgattgtcctacaacacgcttatgcaattcttgttccatacgcaataatttatctttttcgccctccatcatttttgcaacaggaatgcctgtcgcacgtgaaagcacttcagcgatttcctcatcggtaacacgatttcgcaataaagtcatctcttttccttccgcactttcagcttgtgcaagctgtttttccagctcaggaatacgaccatactgcaactcagacattttcgcaaaatcactgattcggcgagcttgctccatttgaattttggcattgtccagctctgccttgatgtgttgagcacccgaaagtgcggctttttccgccttccaaacgtcttccaactccgcatattcacgttctttttcaccaagctcttcctcaagaagatccaaacgcttgcgacttgcttcatcatcttctttttgtaacgcttgttgttccaattttaattgaataatacggcgttctaatctatctaaaggttgtggcttactatcaatttccatacgaatacttgaggctgcctcatcaattaaatcaatagctttatccggtaattgacgatcggaaatataacgatgagaaagggtcgctgccacaacaattgctggatcggtaatttgcacatgatgatgaatttcataccgctcttttaacccacgtaaaatggcaatcgtatcttcaactgtcggttcaccaacaaataccttttggaaacggcgttcaagtgcggcatctttttcaatatattggcgatattcatctaaagttgttgcacctacacaatgcagttcaccacgagctaaacttggctttaacaaatttcccgcatccattgccccgtcagtttttcccgcacctaccatagtatgaatttcatcaataaataaaatcacacgaccttcttcttgtgccaattctttgagaaccgcttttaaacgctcttcaaattcaccacgatatttggctcccgcaattaacgctcccatatccagagaaagaacacgttttccttttaagccttcaggtacttcaccgtttacgatacgttgtgccaatccttccacaatcgccgttttacctacacccggttccccaattaatactgggttattttttgtacgacgttgtaaaacctgaatggcacggcgaatttcttcatcacgcccgataacaggatccaattttccactttctgcccttgcagttaaatcaatagtatatttttctaatgcctgacgattttcttccgcaccttgttcattcactttttcgcctcctcgcaatttatcaatggcttgtagtaaattttcttgttttataccgcactttttcaaactttcacttaaagcacctttatcttcaaaaattgctaataaaaataattcagaggaaataaatttatcttgccgttgttgtgccagtttgtcgcataaatttaataatttgaccaaacttctggaaacctgaatatccccattattccccgaaacttgtggtaaacggctcaattctgcagctaattcattatgcaataatgctaaatttcccccacttgctgttaataatggcgggattgaaccatcttgctgatttaaaagtgcggtcattaaatgaactggttcaataaattgatggtcttttcctatggctaaagattgagcttcagcaatagcttgttgaaatttagtggtaaatttatctatgttcataatctctcctaaaattaatttctgcgtttcatcgtaaaaattaactacataatgaaacgccttctattcgctcactagttaagtaagattaaacaaagatatttcaagtagaaaagtaaaataaatttagtaaaacctattaattaaatgaattttaataggttttacaataaatagagggcattaatgaaaaagttttttcccaaagaaaaataacaataaaccgaaaccgatgacaacaaaaccgataagttgccaaacatttaccgctctttgcgtcattccgattaaaccgaaatgatcaatgatcaaagcagtcagtaattgaccgacaataataaagaacagcatattggtgacgccgattttgggtgcaagaaagatagtggtaaataccgctaatgcacctaataaaccgccgatgagtttccataagggctgtttagggacttgttgtagtgctgaaaataaatccattttccaccagcaaatgaaaaataacgctatcgttcccatcgcaaaggaaacaaaggctgcaaagacaggttgtcccgagagagattgtgctaactgagtattaattgccgcttgtgcggctaatgcgatccctgcacataatgcaattaatataaatggaagtaacatttttattatcctttaaaaaattcagtgaaatgaattgcattctatacttttcaagcaaagatacaaaagctaaaatgtcgcaataatataaatcctataacatgtgctccaagttcaaactttttccataaaaaatgtatgatagacatgttattaaactaaatagcttttaagggaataattatgacaagcacaaacgtacaactcatacaagaaggcgtaaatctaatgctttccggtatgggctttgttttagtctttttattaattttaatttttgctataaaactgatgtctaaacttatcggttacttgtcatatgaaccaacccttcctcagcaagcatttattcctacaacagaattaaatgatttagagcgtttacgtccggttattgtagcagtaatagcacatcaccgtcgtcaacaaaatttacaataacggagaatataaatggctactcacgagaaaaaaatttctataactgatgtggttttgcgtgatgcacaccaatccctttttgctacacgtttacgccttgatgatatgctacctattgcagccgaactggataaaatcggctactggtcgcttgaagcttggggaggtgcaacttttgatgcttgtattcgctttttaggggaagatccttgggttcgtttgcgtgagttgaaaaaagctattccgaacacgcctttgcaaatgttattacgtgggcaaaatttattgggctatcgtcattatgctgatgatgttgtaaataaatttgttgaacgtgcggttgcaaatgggatgagcgtatttcgtgtattcgatgccatgaatgatccaagaaatatgcaacaagcgttaagagcggtgcgtaaaaatggtggacatgcacaaggtacattgagttatacaacaagtccggtgcatactttagaaacgtggttagataccacagagcaattgttagaaatcgggatcgactcgctggtcattaaggatatgtccggaattttatctcctgtcgaggcatacaaattagtcagcgaaatcaaaaaacgctatgatgtgcgtttacatatgcactgtcattcaacgacaggtatggcggaaatggcattactcaaagccatagaagcaggtgcggatggtattgacacggcaatttcctctatgagcggtacttacggacatccagcaacagaggcattagtagctacgttagataacacacagtacgataccggattaagtattccacaacttgagcgtattgctgattatttccgtaatgtacgcaaaaaatacgctaaatttgaagggcaattgagaggcgtggatagccgtattttagttgctcaagtaccgggaggaatgctgactaatttagaaaatcaactcaaacaacaaaatgcttcagataaactggataaagttttgcaggaaattccaaaagtgcgggctgatttaggctatattccgctagttacaccaacctcacaaattgtcggtactcaggcggtaattaatgtattaatgggtgaacgttataaaaccatcgcaaaagaaaccgcaggtattttaaaaggcgaatatggtcgcacaccagctccagtaaatgcagaattacaagcaaaagtcttagcgggtgagcaacctattactgatcgtccggcagatcatcttgcaccggaaatggataaactatccacagaaataaaacgaatggtaaaagaaaaaggtattcaacttgcagagaatgaaattgatgatgtattaattgttgcacttttccctcaagttggattgaaattcttagaaaatcgaggtaatccgaatgcttttgagccggtaccaaccaacgaagtaaaaacaagtgaaaaaccgaccgcactttcaagtagaaatgatagtgctgtttacacggttgaggtagagggaaaatcttttgtagtgaaagttactgaaggcggtgatattagtcatattacacctgtctcgaccgcacctagcacacaatcaacagaatcggcaacaagtgcaactacaaaaaatataccggtaaatgcacctatggctggaaatatctggaaagtactggtaaaagaaggacaacaagttgcggaaggagaagtcttgctcattttagaagcaatgaaaatggaaacagaaattcgagctgctacctcaggaactgtacagggtataaaagtgaaagcgggtgatactgtggctgtgggtgatatcttattaactttagcgtaatcggagattaatatggaaagtattctcgccctattacaaggaacaggcattatgcatttaagttgggggcaggcaattatgcttgtcatcagcttgctcttactctaccttgcagttgtgaaaaaatttgaaccgctcttattgctaccgattggatttgggggactcttatccaatattcctgaagcgaatatggcgttttcggcactggaaaatttacttcatagcaacaacaaccaacatttatctacgcttgcaaatttactgcatagcgataccgacgtacaggcaataaaacaggtactggaaaaagcaccggcgttgttacatgtgcaagcagaattattagcgaaagatttaggctataccgatggtgtgttgtccactttttatgatgtcgccattaattcaggtgccgcaccattgattatctttatgggggttggtgcaatgacggattttggtccattgcttgctaatccaaaaaccttattactgggtgcggctgcacaattcggaatttttgccactgtgctaggggcgttagcattaaacgggttagggatcattgaatttaccttgcctcaagcagcggcaatagggattattggtggtgctgatggtccaaccgctatttatctggcaagtaaacttgcccctgaattattgggggctatcgccgttgccgcttattcctatatggcattagtcccacttatccaaccgccaataatgcgtcttttaaccactaaacaagagcgtaaaattaaaatggtgcaactgcgtaatgtcagtaatcgggaaaaaatcttgttcccgatcgtgttattggtgcttgttgctttattattgcctgatgccgcaccgttattaggaatgttttgctttggtaatttaatgagagtaagtggggtagttgagcgtttaagtgatactgcacaaaatgccttaattaatattgtaacaattttcctcggattatctgttggtgcaaaattagttgcagataaattcctacaaccgcaaacgttaggtatcttattgctcggcataatcgctttcgccatagggacagcgagtggcgtcctaatggcaaaattgatgaattgctttagtaaagataaaatcaatccgcttatcggttcggcaggtgtttccgccgtgccaatggcggctcgagtatcgaataaattaggcctagaggctgatcatcagaactttttactaatgcacgcaatgggaccaaacgttgccggcgtgatcggatccgccattgcagcaggcgtgatgttaaaatatattgcagcaatgatgtaaaaatcattcccttaagattgaaaataaaaataaggacgaaaattttcgtccttattcatttttaatacaatgttagaatttctctagtaacattttttccaatttttcttggtcaatagcaaacttacggataccgtcagctaatttctcaactgccattggatcgctattgtgttgccaataaaattggctttcggttaacggttgaggttttgctttaacttcacctttaaacgctaatttacgcacaagtgcggtgctattttcttgtaattcttttaataatgccggtgcaatagtcaaacgatcgcaacctgccaattcagtaatttcacctacattacggaaacttgctcccataacaacagtgttataaccgtattgtttatagtaattgtaaatttttgtaacagaaatgacgcctggatcttccgccggagcatattctttcttatcgctgtttgctttataccagtcaagaatacgtcctacaaaaggtgaaattaaataaacacctgcttcagcacaagctcgagcctgtgcttcagagaacaatagcgttaagttacaattaatcccttctttttcaagaatttctgcagcacgaataccttgccatgtagaagcaattttgatcaaaatacgatcgttgctaatacctgcttcgttataaagtgcgataagtttacgtgctttttctaccgttgcttgtgtatcataagaaagacgggcatctacttcagtagaaatacgtcccggaacaatttttaaaatttctaaaccgatatttactgccagtttgtcttctgcatcaattagttgctgtgttttatccgcactttttgctttcgcataagcaatcgcttcatcaattaatggagcatattgcggtaatgatgatgcacttaaaattaaagagggatttgtggttgcatcttgcggttgatattttttaatcgcatcaatatctcccgtatcggcaactaccacggtcatattacgcaaagcgtctaattgtgttgtcatagtctttccttttatttagctataaagaattgaactcgcatacaataccatatctttgaaattatgaaatcattattttgcttttaagcgtacagaataagtatattcttcaccttatttataatgctttttagcacaattttatttataatcgagggcaatttttggcaaacaaaatagctcaacaatgaaaaaaaattattacactgtactttctctgtcaattttgaccgcactttatagcacgtccagtcaagcgaacttacaacagcaatgtttgatcggtgttcctcattttcaaggtgaaatcgttcaaggcgatcccaatgaattgccggtttatattgaagcagatcacgccaaaatgaatcaatcgacacatgctcaatacgaaggaaatgttaatgttaaacagggcaaccgtcatttaacagcgggaatgattgaaattgagcaacacggaaaagataatgcgaaacgttatgcgtatgctaaaaatgggtttgactacaaagataatttaattcagctcaatggtgataatgctaaaattcaccttgatagcaaagatgccaatatccaagatgcagattatcaattggttggacgacaagggcggggaactgctgatgaagttgaacttcgtgaacattatcgagtgatgaaaaatgcaactttcacatcttgtttgcctaatagcgaagcttggtcaattgaggctaaggaaatgcgtcaacatattcaagaagaatatgcggaaatgtggcatgctcgttttaaagtatccggtatccctattttctacacgccttacctacaattacctatcggtgatcgccgtcgatctggattacttattcccaaagcaggtatctcaactcggcatggttattggtatgcacaaccgttttattggaatatagcaccaaactttgatgcgacatttacccctaaatatatgtctcatcgaggttggcaattaaatgcagaaactcgctatctgactcgtatcggtgagggaaaatttgtcgttgaatacttaaaaacagatcgtcattctgactatttaaatacggctcgttcacgtcatctcttttattggggacataattctcattttctaaaagattggcgtttaaatgtaaattatacaaaagtaagcgataaacattatttcaatgattttgagtctgaatatggaaacagtacagacggatatgtagatcaacaggcgagcatttcttactatcaaccgaattacaacctttctatttcagcgaaacaattccaaattttcgataaagtagatattggaccttatcgtgcgttgccacaaattgattttaattattatcgcaacgaaattgctaatggcttagttgactttagtttattttcacaagtagttcgttttgataatgacagtgcgttaatgccaactgcttggcgtttccatatagaaccgagtttgacttttccactttccaatcgttacggcagtttaaatattgaaactaaactttacgcaacacgctatctacaaaaacgaggtaaaggagaaaatgcagaagagattaaaaaaacggttaatcgtgttttaccacaaatcaagctggattttcaaacggtcttagcaaatagacaaagtttcattgagggttatacccaaactcttgagccaagatttcaatatttgtaccgcccttataaagatcagtcggatattggtctaaaacaacaaaataatgattacttaggttttggttacgactcaactttattacaacaggattatttttctttgtttcgagatcgccgttatagcggtttagatcgcatagtttcagcaaatcaaattactcttggtggaacgaccagattttatgataaaaatgcaaatgaacgctttaacttatctattggacaaatttattaccttaaagactctcgcacagataataatccacaaaatatggctcaaggcagatcttcttcctggtctttagaaagtaactggcgtatcaatagcaaatggaattggcgtggaagttatcaatatgacacacatttaaaccaaacatctttggcaaataccgtcttagagtacaattcggagaaaaataacttaatccaactcagttatcgatatgttaaccagtcttatatcgatcaaaatttaattggtaaaaatacttatggacaaagtataaaacaacttggtatgacaacagcttgggagctaactgatcattggacactggttggtcgctattatcaagatctcgcattgaaaaagccggttgaacaatatttgggaatacaatataactcttgttgctggtctataggtgttggagcaagacgttatgtaaccaatagagcaaatcaacgcaatgatgaagtgctttatgataatagcttaagtctcacttttgagttacgtggattatctccttcagatcataaaaataatatagatgaaatgctgaaaaaaggaaaactgccttatattaaagcctttagtctatactaacgttcaaatttaacgaaatataccaaaaaacaaaccgcacgttaagtgcggttttcttttagattatgttgaaaaattacagtacatcaacacagttcaaatcttcgaaagatttttctaaccgtttagacatagattcttctgctttgcgtaaccaaactcgaggatcatagtattttttattcggtgcatcaggtccttccggattacctaattgaccttgtaaataagcttcatttgctttatagaagtttaaaacgccttcccaagttgcccattgggtatccgtgtcaatattcattttaatcgcaccgtagctgatcgcttcacgaatttcttctgttgaagaacctgaaccgccatggaatacgaagtctaatgatttcgccggaagattacgttctttagaaacaaattcttgtgaggcacctaaaatagacggttttaattttacgttgcccggtttatataccccgtgaacattaccaaatgctgctgcgatagtaaaacgtggactgattggacttaattgatcgtaaacaaaaaggacatcttccggctgagtataaagtttagattcatcaacatctgagttatctacaccatcttcttcaccgccggtaataccgatttcgatttccaatgtcatccccattttatccatgcgggtaaggtattcacgacaaattgccatattctctgccattggctcttcggataaatcaatcatgtgagatgagaacaatggtttgcctgtttcagcaaagtgtttctcgcctgcttccaataaaccgtcaatccaaggaagtaatttttttgccgcatggtcggtatgaagaataaccggaacaccatattctgccgctaatgtatgaacatgtttagccgccgcaattgcacccaatacatccggacgaataccgctagccggtttaattccttttcctgcataaaatgccgcaccaccgtttgagaattgaataataacaggtgcttttactcgtgcagcggtttctaatactgcattcacagaatctgtaccaacacagtttactgccggaattgcaaagttatttgcttttgcgtaagcaaatactttttgaacgtcgttaccggttaatacaccaggttttacaatgtctagtaattttgccatttttatatttcctatataacgtgcaattcttgcactactaaaaattaaatcaatctacaacgtaaagtataatgcttttcactttacaaaattaaccatttgctcgtttttctaaaatttcaaccgctggtaatactttgccctctacaaactctaagaatgcaccgccaccggtcgaaatataagaaattttatctttgataccgaataaatcaatcgccgccaaagtatcaccaccaccggcaatagagaaagcaccatttgcggttgcttcagcaatcgcattagaaacgatttcagtacctttacgaaagttagggaattcaaagacccccacaggaccattccaaagaatagtttttgcattgcggataatatcagccaattgctctgctgatttatcaccaatatcaaaaatggattcttctccggaaacgtcggctacacttttttcttttgatagtgcggtttctgaaaattcagtgcccacacgcacatcaactggaacaggaatattcgttacttttgataaacgttgtgcttcaggaattaaatccgcttcatataaggatttacccacattatgcccctctgcggcaatgaaggtattcgcaataccaccaccaacgatcagctggtcggcaatttttgataagctatccaagacagttagtttagtagatacttttgaaccgcctacaatcgctaacattggacgttgcggttcttttaatgctttacccaaagcatccaattccgccgctaataaaggacctgcacaagcaacaggggcaaactccgctacaccgtaagttgaggcttgtgcacggtgagccgtaccgaaagcatccataacaaatacatcacaaagtgcggcatattttttacttaattccggatcgtttttcttctcacctttatttacacgtacgttttcaagtacaacaatttcaccttcattaacgtccacaccatcaagataatcttgtgctaaacgaacattaaaaccggcacctttcaaataatcaacaacaggctgtaatgaatcttcaggtttaaattccccctctgtcggacgacctaaatgagaagttaccatcactttagcacctttctcaagtgcaagttttaacgtaggaatagttgctttgatacgtgcatcggaagtgactttcccctcttttaccggcacatttaaatctgcacgaataaatactctcttacctgctaaatctaggtcggtcattttaattactgacataattcaccccttatattggttaaaattgataaaaactaccgcacattatacctagttatgaacaggttgtaacgaactagatcaaattggctttaatatcttgttgcataaattaaatcattaacaaaaaactcacgtttctattaataataattcaatccggaataactgaaatccctattcagttttcaacggatattctttataatcagccctttttacaacagagttaaaggacatggcgttactcatcactgataaatgtacaaattgcgatatgtgtttaccggaatgccctaatgatgccatttcaattggtgatgaaatttacattatcgatcctcatctttgtacggaatgtgtgggacattatgatacgcctacctgtcaaaacgtctgccccattaccaactgcattaaaaccgatccggaacatattgaaacggaagaacaactttgggaacgttttgttttaattcatcatgcagacaaaatataaaaaaaagggcgtataaacgcccttttttgatggatgaaaagtccagaattaccagctataaccaactcccgcacccacagaagttttcttatcaccatgtcctaagctgaacttaacgctaagtttgccgttatcggacactctggaataacctaccgcaaaggcttgactccccatatagttaccggtcgccaaacttaacgtacttttacccggtaatatattgaccggtaagttcgcttgtgcaacagcttgtgctacacccgcacgcatattgcgatcattattgttcatttgtgtccgcagttcattgtttttggtatccacgtagtttttgtttactaccacatgaccatctgcattaggtttaatattcggcacggtgataaccccttttgtaccatcaatgtgaatctgaccgcctgcaccgttcactgtcaatccgtttttgttcagctcggtacttagtgcggtcgcttgggttgaactgtccgcaaaacggataccacctgcggtcatcacagccttatcgcttttgtttttatcttccaacaccaccgcttccgctccataagttgcagatttggctttatcatcagtgccatctttgcctttattgaccactctcaaaccgttgctatccaatcggggytttctaccgttcacttcacgagtttcaaacgaagtcatgttytkyarctkrtcrgacaatttaacttctaagcctttgccgtcttgtgacatttccactttgatattrcckgyggcrgtgmggtygctgttaaaygttccctcgcctgtgatggacagggtttcaccgacatttttatgcacggttacatcatcattaccgacaaaattcagccccgctcgtgccacggcttgtaaatcgccaayggtrgckacrttgcttaamtyrgcttsgctatccggttcaaccagttcttcgacttttgctatcgcctcggaaaaggcgttatagtccccatttgcttcwattaactcgttgcgtgccgattctacggcttctttagcattctttttagcctcttgagcatctgacaattgmgtttcgtattttttcaaatyctcacgmattttytctttmgcttstccatcaggcatrgtrtcmacggtttgttttaaactgtctaccattaactgtaaatcagcaaatttttctgctttctcagaaaaatctttcattttttcaccyaatgccgtcactttttcactcacttcctcagcaagctgattaagtttttctttttgttcgtctgttggtgttgtaatacccaaaccactcgccacattgctaatcccgataggtgcggtgstyggttcggctttaatcacgacttktttcwyytcttcytcrgwaagtttttcactaggtttaccgtcttttaattttttgaaactgccatcagcccctttcacgactttttcgccattcagataaaaatcaaacgggcgattattgtttaagtcggatactttttcatccacatagtttttattcgctgcaagggtgccgtctgtttcctccggtttaatatcagcaagaccggtgattttgccggtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggcgtgagkgaaataccatckytatyraywttcactttagaacctggattgccaacttggaaagtagcaccattatttggatctaaagtaagtttagtgacttcatcttgatttccamccgcacttgaacctgcaccgcttccgcccgcacttccatctttaggtttagaggaaatcgaggtgatgtttttcaattcctcagtcgtgccaatggttaccactgccgttgttgttggggtagtggtagttggcgtggtagttggtgtacttgttggcgttgtcgtagccatgcctgcaccatttgaaccacctgacgaagccatactatttgaaccaccgccgtttgaacctgcaccacctgatgaactgcttggagctgctgatgatgctggtgctggagcagctggtgttggagccggtgcggaagcactcggactggtagatcccgtacttgatggtgttgtaccgtttttagctaaatctactttaatattctgaccactcgtaaatttcaacgtatcgccacgaccgatttcaacagtttgaccgccaccattttcaaccttgaacttaaagctacttaacgcttcttcaagatagcctttggtgatgagttcatttttccaatctgtacttccactatttcctcttccgccatcatatgtttgctctttagaaagcattactttgctaaatrtcggtgcrtytttaaasccgatttcgattttggcgttgccgttagtttckctcgtgtattgagtgattaaattatcacctttaaactcagcaatatttggttgtgatgaagtccccgccggagctggtgtggatgtcgcccctgccgtatttgaagctaaacgaacaatattaatrgtcgaaccragatagtgcggtgtgttttgagtgccatttgttmccgcactwggaatatcascrcygaayttyaagccytcgttgagtttmkwwacagyattttkcaakccytcwackatryttkttggtrcwkttccatctgttccwkyaaccycttttaatttraartcatyaaatgttggwgckktaaakkysgttttakytkwakyatcaacctcaatrcctaaytgyttmgctaaatcmgcsagttgtttacctgttacggcktcttttgaattctcagcaatttcaccgtctgcaaggtttttgagttttgaatcattaaagctgatttcttttttagctgtttctaacgtgattttygctccactttcatctttaccgcytttratactggtgatttcttgaagattaytattcarygwatgcktaatwwytccmtyakcytckacagmaacagaaatattttccgacttcacgaagtccaacgcccctgttttgaggttgatagattgtttcttgtygtcttgacyattcgctttatacgataacgtcaaktcgtccacatattkcttattracggcatcatatttatcagttggtgttgcaacataaacaattcktctttgttcatctttgcctgagccgcctacagataccgcatytgmtwcwsctkttgatttrttgcctaaaatgacrgcatttgttatatctttagttgtcgtnayayttgaacccaagacatargtgtgttcgcctttgatgtcattataagcacccacarcataggaatgctttccgctaaccgtgttttgtttcccgaatgcaccggaatgattgcccgatacattatttttgtaaccaatagccgtagcatgctcgcctaatacatcagcttctctacctatggcaagtgagtttctatttttggcgttagcaccatagccgatagcaattgcactttcattttttgccactgctttatcccccaccgcaattgagccttcgccatctgccttggtttccggattatcggaaattttaacggatttatctcccgtgccttttannnnnnnnnnnnnnnnnnnnnnnnnnnctaattcagtcgtacttttttcagtttcgccgagtttgatgttatcaatcccaacattttttcctaaagctcattttttaycgyyaatattcgatccatccactttcaggaagtctttacccaactgtgctgttgwsgtrtaytytttcaaytytkywgctacsgctttwgargtmacracttttycatcgctktcrkmmacyktrkykgctttatttaatttcagygtaagtgtacccgcactttgaggattgttaccattagatggtgctaatgatacggtgatgtctttttgtgtggcttctgccataccatcggcttttaccttacttgttgaactatcaatggtcaacgtaccgcctaattgtaatgtggttgagcttggggagctaccattatcattccccttgaatgtcaatccaccattgaccgcagtaattaaytggtcrattgcacctttraaggttgtaggacctgtattgctattagtcgtgccagcagttgaactcgtaccgcctttaatggcagtaaatgacggttggctaaatccggtttcactatcaacagcaacccccaatttacttgctaaatcatgaagttgtccgcccgtgatggcttcggttgaactagtatcaatttttccatcttccacattcgagattttcacggtttcgccactatccgatttagtaaacgtyaaygmwyttccrccgacttttaactcngcyrttttrtcagtgycastcsyacyatttttaaacactaaagcrttatymtcatctttaccgatggtagacaagccggtggcttgcactccgccatttgtcatgtcttttttcaacataacggttgagccgttttccggacttaactcaattttgttatccnnnccattggtaactttaatacttcccttatctttacccgcacttaacgttgcactannnnnnnnnnnnnnnnnnnnnnnnnnatctttggcactttctaaagttaccgctttatctgtcaattccagtttggatttatctttggcactttctaacgttgcactattgtcagtaagttttaaygctcctttattstytcctttgttaatttcagaaacayyrctaaatttaccygcacttagggtgacrtcttttgwkcytgyttggtckccwgckgtraaagtwatggyttttttrtcattctccaamgcrattttkgcgttatccccattggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccacaatttttaaggtctcgccgagttttctggtgacatctttagcgtcatttccttggaacttcagccctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaccgctcgcaatgcctgtgatttgcttattatttaagtctaatctatcagcttttaatgtcagatctgttcctttagaagagattttgagaccatcgctatttgcaaagtcaatctgcggagtcgtgccaccgttatctttacctgcaatcgaagtgatatttttcagatcggcatttaatttatgcgtaatcgcaccgccagcatctgctgtgacagtgatattatcatcatttttaaaatcaagaccttcggaaagtttaactttattatcacctgctccattagccttgtattttatctcttggttggcaatcgcttgctcgttttgagtcgctttactgtccacatattttttagtggttaaggcagtctttggacttttctcatttatttcttcagtgaccgttacttgtttaaaagatggtttatcttttatgccaattaaaagctcttttgtatttggttgatatgatgttttaatattatcgctactaaatccatcatcactggttgattttttatcgatattccctgctttaatgtgtaaggtatcccccagttgaagcgtgcctgttgctataccatcgctcacgaccagtcctttattcaccgcgacgatcaaatcatcgattgcttttttaaaggtagtttttccgttagttgctgtttgcccttgataattgactttggtaaaggacggttgtgtaaatccagctttcgcattatcgacagtcacacccaatttgcctgccaaatcatgcaattgttttccggtaatcgcctcatttgaagcaccgtcaatttgcccgtctcccagtccagaaatcttgaccttatccgtatcggattttgtcaatgttaatgccgcaccttcttcaggcattaactttattttcgtatctgctaaggagatttttgttttgtctttagcgatagactcaactcccgtcaatgttgaacttaatccataagatattttyttattagacttatctaattcaacagttaaattagaatcttttgctgcaaattctaaagtatttcctattaggttatcgctagtggtacctcctgccttaaccataaatgttttattaagtttatctttaataccttgatcaagttttgcctccgctattgtgttatcttttaattttgtccctgcaattgaagcatcttttaaacttaatgacgcattaccaaatacttttccgccaccagtaacttgaatttcatcgttaccagttaaagccttcaatccactttcaataactattttagaagccccgccgtcaccgtgttgaactttaacatctccagtagccccatcaacagtaatttttcctgttttatttgtagcactatgaccactactatcttttagagtgatagaattaatgtcttctaagtctttatttagtgctaccgtaaattctcccgtcttatcagaatttgttttagataatgaaacattgatattgcttcctgatttaatgacaacttttttgtcgttctcgctattttttctgacaaagtcattattcgtagtcccatcactaaaggtaatacctgccccatttaccgaagtgagcacctcatcaagagcagataaagcctctcccacggttgtgtatggtgccttatttccattagctagtgtataagacggtgctgttacatttccgtctgcacctattttcgcctctccgcctaaagcactcacaacaaaattgagttgcaatttgttaatagcatcattatcagatgtaccatttgctacgttggaaattttaactttgccgccagaatcagttaaatttaaactggaaccaccagctttaagggttgtcccgctatccaaaaatgcgatttgattattggtatctttaccaatagatgtaatgcccgttaaagcctcttttaatgtgatactgacttttttattgtccttatcaactttagtttcaatatttttagtatctccattaatatttaagacattgttctgtttatttaatgtatatactacgttattatcccccttaacatcaaaattagcggcgacattagctaatttcccgtccacataggttttcgtggttaatgtcttcccatcactactatcatcgactgttccactcactttgacttctttaaaggtcggtttgtctttgataccgattaacagctctttgctttttgctagatacgctgttttaatattatccggtgaataaccgtcgtctgaagtgctcgttggtttatctacagctcccgctttgatgattaatttatcgcctaagtaatgcgttccttgttcattattagaatctccaacaccaaaaataaatcctttattaatcgctgttgtattttgaccaatggcatctttaaaggtcatttcttttgatgtttgagtatttgtattcccattatatttaacaacatcaaaacttgattttttaaatccgctcgttaggtctgcctctgctcctaatacattaatagctaatttagaaaacgcatctactacgccatataactggcttccgttaatagcgtcggtggagtttacttccactttacccgcagcaacgtgagtaatcaggtgttctttgccggtatcgccaacactgatcactgattttttactctgctctttgtcatcagcactgacaccgcctgtccagttgaatttaaggttgtcactgccgacagtcacttttgcttctttaggtgcggtcattttatcgacagtttttgcatttttacccaatgcgagcttatcgccatctaccgtaatcatgcctaatttgtttttggtattttgggcaaaactgagagtgatactttgtttatcctgctccacttttgtctcaatttcatcactcgttcctgccactttaagtttttcgtttttcaaattcactttaccggtcggaccgctatttttagaattatccgcctctaaccctaaggttgtactaatcccatcaattttcgaatccagataagttttaaccgctccggcggtgacaactttgtctttattgctatttgttgccgtattgtcatcaatgcttgttgctttgtgcaaagtaaaggtaatttccccttttttgctatcagtcttagaagtcagatccgtaccattgcctttaatggtgagtttttcgcccaatttacgggtgatttcagagccggaatttccggcaaatttcagtcctttttccacaatcgctttcgccacgttggataaatcgctgacattgacagcatttcctttaattgttgttatgtaactgccatctaatatttttgaaacattttccggatttccgttcgctcccttaggtccatgatgctgtgtatttaacccgctttgtaatcgggtaattcttctatcggacatatcaaagcccgttctatcaaatgtatagtttgccccatttgatgaaattgttacatttgtcgttgcatttgacccatttgtgctattaaatgctatcttgctatatacagtatttttaccgcttttaatcccttctccagtaatacttgcaatgtcttttaagtctttatttaaagatatttccaactctttttcattagttttagcttcagtagtaatatttttatgtcggctagcgtctgctttccccttaatatttaatgcattttgaacaatatagtttcccgtattaccatttacagtaaaactagttgcaacattggcaagttttccgtcgacatattctttcgttgttaatgtctttttatcgcttctatcattcacagtgccacttattgttacttctttaaatatcggtttatctttgataccgattaacagttcctttctggttggttgatagcttgtcttaatattatcactgctaaatccatctacatcagattttggtttatcgatatttcccgctttaatagttaacgtcgaacctaaattaagtgtacctgtatggctgtcagcgtcttggattacaattcccttatttaccgctgtaatcagttcttcaatagcatctttaaaaatagttttttgtttcttttgagaaccttcatagtcaaccgctgtaaacttataactatcaaattgcgtgttattgggggtatttactgacacacctaaaatatcacccacatttttaagctgattccccgtaatcgcctgatcagaagtttgcgaaatctctccatcggctaaatgcccgaatcttatcttttctcctatgtccgcaatttgtttatcagcatctatgtattgtatcttctcgttatgccctttagccccaactaatactttttcttttggaatttcttgtttatctaatggtgttccatattttgtattgaccttatagaagttgccatctgttcctttaactaatttatatatttttccattatcttgcgtataataaacgactaagccttctctttttacatattctaaggcttttaattgtccaatcgtcgccacgtcagagtccaacgcacccggtgctaccccgacaatccgtcttaagcccagttcttgactatcacttttaccctttgtccaacctaccgacacratacccgctgttttatcggttgttaagttatarctwgamccctctggaatataaggggctaaatyaatcgcatcttgtccgctgagcgtggctgtgtttttgttatcatcctgatagaaatattttgtatgtgatttatagcctaaggcaacggaattttccattgttgcttcggtttcattacctaatgccatcgcactttttttagtcgcttttgaagttgcaccaaaagcaattgcattttcagaatctgcttcaatttttgcattatctcccaaagcaatccctttttcagaataaacatgtgacttggtacctatagaaatcgctgacatttctaattctactttgtcacgctcagatccaaattttctgtttttctcattctctattttttgagttagattttggcttttattttcaattcttgcattattaccaataacaatagatttttgagcgtgtacttttagacttgcatcatttcccaaaacgatactttctctagacaagccatgagaaccataccctattgatattgtattgtcttttgtaacaccaactccggaacctattgcaattgctcctgcaccgaagacatttactcctgtaccgatagcaacagagttttctttatatacattagtaccaataccaagtgcgatggtatttcgtgcatattttccaacattatttaatgcacccaatactacagagtttgctccccttactactgatgcactacctatagcaatagtattatccccattatttgaaagatgatatcctaaagatatggcgtgatctccttctttagttgttttatatattttttttgttgtttcaattacttcatcatgttcgtaagcaaactttatattttttttgtcgttaattacttgttcaattatctttgatactggatttttttgattatcaggattaagtgccctaaatccaagtttaacaataggatttttatctccatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatttgatgatacattttcgcctatcgcgattgatccaaatcctactgcttttgatcctgaaccgaatgttagtgaacctttattagttgcttctgcttcgtttcctattgcaaatgaattagttgcaaaaacccttgattcgtctcctatggcaaccccaccttctgcatctgcattaacaaacgcacggataccgacagccgtagaatcttttcccaaagcaaatgataatgtaccaattgcaagtgaagcatctccaaatgcaacagaccttgatccaatggctattgcacccactcctgctgcatatgttggagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcatcattacctatggcaatagaagcatagccagctgccataacatctgatcctatcgctgtagcttgttgccctccagaatatacattgtttcctattgcagttgtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgtccatatctatatatactatatcagcatatgaaacactgctcacaccaagcatccccgacatcaacaacgccaacggcaacaccttaaacatgcctaaaaaattacccaaaaacacaccgcacttcggtttactcttcgaactgctcgctatttggcgattacttgccaactcggaaacggctttacattgacctgttgtaatatcgtattttgttttgaagattttgttcataaattcactctctttaatcttttaaaattaggttttttattgatttattttgtcgatttttttaacttttttatagttattaatggattaaacgttttgctttttaggcagattaatgaggtataaatmggcaataccttgctttttaagrcamarcaraaaaaggcgaataatactttcgccgaaaggttgaggttgaaataggtgatttttaagatattgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcattctattcctgttatatgtcgtgaacaaataatatatcgagccgattattctagcctaactattatgagaaataaaaggattttttagttaaatctgatttgatgtaagaaggctttggtgcgttcatgttgtgggttttcaaataacgtttttggcgatccttgttccacaataatgcctttatccataacgaccactacatctgccacatctaaagcaaatttgatttcatgcgtgactacgaccattgtccaaccttcgttagcaagctctttcatcgtgtttaatacatcttgaactaattcaggatccagtgctgaggtaggttcatcaaacagcattaattcaggtcgaatagctaaagctcgtgcaataccaactcgctgttgttgcccgccggaaagttggtgtggatagagattagctttgtctattagccctactttacataataacgtttccgcttcttggcgtacttcatcaggcttgcgttgttgtacttgaacaggtccttccatgatattttctaatgcggttttatgtggaaataaattatattgttggaataccatgcctgattttttgcgtagcggtaaaatgtttttgcgaatgtgtttgtccgtaaaatcaatatacagcggattttctttgtgaaattcgattgtgccttgttccggtaattcaagggcatttaaacaacgtaaaaaagtcgttttacctgaacctgatggtcctaagatgacaacaacttgacctttttctatatctaaatcaattccacgtaatacaggattattgtcaaatgttttatgaatattacgaattttaatcatcatttatccttggttagcgagtaacataacgagcaagttttttttctatgcgagcttgccataagaacaagataaaacagaaacaccaataaatcagggctgcctcaatataaacgggtaagaaatcgtaagacatatttgctacttgttgtgccactcggaacatttccgttactgttactaccgaagctaaagaagtgtctttgaataaactgataaatgtattactcagaggcggaacggcaacacgaaatgcttgcggtacaataattcggcggaaagtttgcatataagtcatgccgattgtgtaaccagcttcccattgtcctttggggacggattgtatcgccgctcgtaccgtttcagaagcataagcaccgacatttaatgagaaaccgataattgcggcaggaataggatcaataaaaatccccagtgcaggtaatccataaaaaacgatggatatttgcactagcattggtgtcccacgaataattgaaatataaatttttgttataaataaaaagaggcgatggataatgctgtggctcggactcactcgaattaacgcaacagcaatcgcaataaccattcccaatataaatgatacgatagcaagcggtattgaaactaataccgccgctttgaccatgggaaaaaatccattgatgactaattctgctcttgcctcagtcataaaaggcaatgaggcaaggaaattatttaacactgatatctctaccaaagaattgttcacctaattgttttaatgtgccatcgttgcgtaattcttcgatagctgcactgatttttgctagtgcttcatcattatttttattgacaataagacccgcacccactttattttcagattcccataccggttttaaacctgaatttgggtattttttcaaataatccaataaggctagtgcatcgttaaacgtcatatctgctcgtttttgttgtatgagtaataagccttgtgccatgccgtcaataggaacaatcttagcttggtatttttgtgccaattcaccatagtttgagctaagtgtttgtgctgcttttaagccttttacatcttcaacttgtttaatgcgagtttcattatctcgtgctactaacattgctccggaccaactataaggttcagatttgtcaaaagtggcttgacgttcaggtgttgttaatgcgacttggtttgctaccaaatcaaaacgtccagcttttaaaccggcaagcatcgcgtcccattgtgtttctttaaattcaacggttacacctaattttttagctactgcacgagtcacttcaacatcatatcctgtcaattttccggttgagtcatggtaagtgaaaggtgcgtaagttccttctgtaccgaccgtaattgttcctttgttgttaatgcgatctaataaactcgcttgagctgaggcttgtgtgttggcgactattgcaaaaacggtagtgaataaaaatgttatttttttcaacataaaagctcctttcagtaaaaattgggttgcggtaaaaaagagtgcttggcattgtaaaagaaatgttaaatattacaaataactttcgggaatatgttatgcagaatgggtatttttatgaggcgatgaaaaatgatccggattcaacgcctaaagcttaagctgaaaaattagcaagcgagtaaaggaaaatcaagcgatatttcgttatataacttgaaataatactgaataatagctatattacgacaaagggcgtaagctgccacaagtgctacttaatcgggcgtaagctgccataagtgctacttaattaggtgcaagctaccgtaagtgctgaagaaaagatgcctaacggcatcttttttttgctcaaattctcatttggaatatgacgatgaatgacaaattaaaactatatcgtgtaacggatcactatcttgattttttaagagatgttgagcctaaaatcccaatgaataaagataatggaaaaaaacgcccttttgttggcattgttctttccattaacggcgtaaaatatatcgcccctttatcttctaaaatttgcaaaagccaaagcgattttaaagtgaaaagtggcggtgaacaaaaggcgactattcgatttgcgtatatgttccccattgttgatagtgctttaattgagattgattataccgaagaatttaaaatagattttaaatatacggcattgctcatcaaagaggacttatacatcaatcaacataaagcacgtattcacgaaattgcaaccaaaacgtatactaatgcaatcacaaaacgctttgggtttgaaaatttctgttgcgactttgcaaagctggaagaaaaacatcgagcttatgaagctcagtaaaaattgctccagtgtatctgctagggatgtttttatagaaagtatatttagaacaataggttagattgaaagtgcggtgttgttttggtggttttgataaaaaaatgagctttgataagtgaattaggacttaaaaaagctcattttgtcatatcgaaaaggtcaatgtagccagaataaataggcaaatgtaccgataaacagtacgcaaataatatttaagacaacacctgcacgaaccatttctttttgtttaatttcgcctgtaccaaagacaattgcattcggcggagttgcaaccggtaacatgaaggcacaagaggcacctaaaccaatgatcaatgctaaacctaattcaggcatgccaagtgaccgtgcaatagaaatgaagataggaactaataacgccgcacttgcactgtttgaggtaaattcagttaagaaaatgataaaggcggcaactaataaaccgataagatagaagttcccaccttcgatcatgaagactatgccgtcagccaaaactttgctcgcacctgagtcttgtaataccgcacttaatgttaaaccaccaccgaaaagcattaatacgccccaatccgtattatcttgtaactgtttccaagaaattacgccgctgacgcaaacggcaatagcggcaagtaatgcgatgacactgtcaaaactggcaatatttttttccaaccctaataaagatgacagcattgggttgagtttggcactaaatatccagcaaaatgcaatagttacgaaaatgagtaatgtaatgatccgttgattattcatctcaactttctcaaagttttgtttgaaactcgccttgagattcggtttaaagataatgtaaagagtaccgatcatgattggcataagaataagcatgataggtaaaccgaaatagagccaatcggagaaagataatttcaattgagaagcaacaattgcgttgggcggactaccaatgacagttcccataccgccgatactcgcactgtaggcaatacctaataagacgaatacataagtgttatgttctttcgttctatctaattggctaagaatacccatagctaacggcaacatcatcgaagctgttgcagtattgctcatccacatagaaagaaatgcggtaattgagaaaagataaatgacgccaataaagagatttccttttgccagcatcattattttattggcgatcattctatccaatttttgaatatgcagtgcggtagcgagggcaaatcctccaaagaaaaggaaaatagttggtgctgaataagaagctaaagcggtttttgttgtgactaaacctaatgcaattgctataaacggcactaataaggctgttactgttacatgcagtgcttcagttagccataacacagcaataaagactaataaagccagtcctttatttgctttttcatcaaagggtaaaacataaagtagaacaaaaaaaacgataacatcaagaatgaatattaacgcattttggttaaaaattgatttagacactgttttgctcataaggttatcctgcttagataaaatattgaactatccctatttgggggtaggaatttgagtgaaagttaccaaatggtaaaaaaaatgcaacgaccttttgttttttttgtgaggtatgtctaaaaaataaaaagtgcggtcttttgcaccgcactttttgtaggaattaatgctgaatggtgattataagctatcaaactcttctaaatctaaaggctcttgagaaagaataatgccggtaagatctgcataaacatagtcatcaggaaagaaggttacgccaccaaaatttaccggaacgtccgtttctcctatgctttgttcatctgaaccgacagggataggtgcaagtgcttgaatgccgatatttatgttttctaattgttgtaattgacgaattgctccgtatacgataatcccttcccaaccgttatctgccgctaattgtgctaagtttgcatcaattaatgcacggcgaaccgcaccgccaccatcaattaatagcactcgaccttcgccattttcttcgagaatttcactgattaatccattgttttcaaagcatttgattgtggtgattttcccaaagaacgtgcttttgccgccaaaactggaaaaaataggctcaacaacatcaatttgatcgaggtaaatatcacaaagttcagcagtatcaatatacatagggttttccttctatatttcggacagttgttaagtataaccaatattagtttacaagcaagctcaaactgaataatagattcgtgaacaaggcaagtaaggacatttgtgcaagcattgggcgtaaatgtaacggatttttattgcgatacacaaaatgtgcatgcttgatcagcagtggaaaagaaagaataaagataaaatttgaccaatgtgtaaatgtgtataaggcaaaaataatataacttaatgcactgagcaatagaataatgcaatgataaatacgtgcattctcagcccctaaacgtactacaagggtatttttacctgcttttctatcttgttcaatatcacgcaaattattgatatttaataccgcagtagctaataagcctgttgcggtagcagggagaaaaataagccaatttagctgatgggtttgcagataataagtaccgccaacaccgagcagaccgaaaaatataagtaccgaaacatcgcctaaacctaaataaccataaggttttgtacctacggtataagtaattgcggcaagaatggcgagtaaacccaaaagtgcaaaggcaacaagatcaacaattgtttgataagcattcacaatcagtaaactgccggaaatcaaactcaagaatacaacaagaataagtccttgttttaattgttttgcgttaatagcaccttgttgaatagcacgcaacggtccgatacgttcttgtgtatcggaacctttttgatgatcgccataatcattggcaaagttggataaaatttgcaatagcaaggtcgttaataaacaaagtaaagttgttgtccaactgaattgttgtgcccaataagccaatgccgagccagtcataattgaggcggcagccaaaggtaaagttttgggtctagctgtttcaaaccacattttgacactattatttgccataatatccacattataattgatacaaaaaatgaaattttcaccgagcgtgtacacttgcgttattctactgttttattgatgagtttttaactgttttaaggaaaatatgtccggttttttacttcaactgacaccgattgcgataattcatacgccgtacaaagaaaaattttccgttcctcgccaagcgaatttagttcaagacggtacgggagttgtggaattgcttccgccttttaatagtcctgatgctgtacgtggactggagcagttttctcatttgtggttgatttttcaatttgacaaagtgccgacaggtaaatggcaacctacggtacgccctccccgtttaggaggtaatgagcgtattggtgtttttgcttccagatcgacacatcgccctaatcctttggggttatctaaagtggaacttcgtgaagttgaatataaaaacggaaaggttttgttacatctcggttcagtcgatttgattgacggtacaccaattttagatattaaaccttatattgcctatgcggataatgaacctaatgcaagatcgggatttgcccaagaaaagccaaagcaggaattgcgagtggaatttagtcctgaggtgcaggcaacactggaaaaactggaaaaaaaacgaccgcacttgaagcgttttattcgagaagttattcagcaagatcccagacctgcctatcagaaaggaaagcgttttcataaaatttatggtatggcactgtatgaatttaatgttcgttggagaattaaacatgatgattttacagtggtggaagtgattcacattcagcatgtttgatcttcaaataaattttttgatccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaatttatggtatggcactgtatgaatttaatgttcgttggagaattaaacatgatgatgatgttacagtggtggaagtgattcacattcagcatgtttgatcttcaaataaattttttgatccacttcacatttttacagttttcttttttctttttatgaaattttccattaaactactttttgtttaatcgaaacgtttcgatggtaattatcaatgttttctctgaataatttcagaaaaactggagaaaattaatatgaagaaaacaaaattattaaatgcgagcttatcacattatattgcaacgttaggccatacagacagtttggttatttgtgatgccggattgcctatttcaaatcaagttgaacgtattgatttagcgttggaggcaggcgttcccgcctttttacaaactgttgatgtggttataagtgagatgtttgtggagcatgccgttgtggcgaaagaaattagagaaaaaaatccgcaaattcatgacgcacttttagattcgttaagaaaattatcagaacaacaaggcaactgcattgccgttgaatatgtagaacatgaagaatttaaagtattaagttctgagagtaaagctgctgtacgtacaggggaattctcgccgtatgctaatattattttgtattcaggtgtgccattttaaccagttgaagagaggtatttatgcaagtggaaaccttgctcaaaattaccggcgtagataaatcttttccgggtgttaaagcacttagtaatgcttgtttatctgtttatgcgggacgagcaatggcacttatgggagaaaatggtgcaggtaaatcaacgttaatgaaggttttaaccggaatttatagcaaagatagcggttctattgaatatttaggagatgttgtcaattttaaaggacctaaggattctgaaacggcaggaattagtattattcaccaagaactgaatttagttgcaaatttaaccgttgctgaaaatatttttttggggcgtgaatttacaacctcttggggagcaattgattggaagaaaatgtacagagaggctgataaattattagcacatttgggtgtgtcatttcgcagtgatcagctttgttcggaattgtctattggtgaacaacaaatggttgagatagcaaaagcgttgagctttaaatcaaaagtgatcattatggatgaaccgacagatgccttgacagatacggaaacggaaacgctttttaacgttattcgtgaattaaaagaacaacattgtggcattgtatatatttctcatcggatcaaagaaatttttgaaatttgcgatgatgtaacagtattacgtgatggacagtttattggtgaaagtgcggtgcgagatctcacggaagatcgtttaatcgagatgatggttggccgccgtttagaggagcaatatccgcatgttgaacaagatcgtggttctgttcgtttggaagtaaatcagcttttcggtagcggaatatgtgatgtgagctttaaactatatagtggtgagattttaggtgtgtcaggcttaatgggtgccggtagaactgaattgatgaaagtgctatatggtgctttgcctaaagaagaaggtgaagtgcggttaaataataaagtcatttctaatgattctcctcaagacggtttaagaaacggtattgtatatatttctgaagatcgtaaaggcgacggactaattttgggtatgtctgtaaaagaaaatatgtctttgaccgccttggatcatttgtcaaaagccggaaaaattaatcatcaagcagaaaaaatggtggtagatgattttattgagttgttcaatattaaaaccccaaaccgtgaacagcaaataggcttgctttctggcggcaaccagcaaaaagtggcaattgctaaagggctaatgactcgtcctgatgtacttattttagatgaaccgaccagaggcgttgatgttggtgcgaaaaaagaaatctatcaattgattaataaatttaaacaagagggattaagtattattttggtttcatctgaaatgccggaagtacttgggatgagtgatcggattttagttatgcacgaaggtcgtattagtgctgaatttagtcgtgaagaggcaacacaaggaaaattacttgccgcagcactcgggaaacataattaagggaattgtatgaaatcatcatttaaattgggaaaaatgttattagagcaacgttcagttattgctttgttgatacttattgctattgtatcaatgattaatcctgactttttcagtattgataatattcttaatatcttacgtcaaacgtcgataaatgcgattattgcagtaggtatgacttttgtgattttgattgcagggattgatttatccgtcggttctattcttgcgttgaccggtgcggttgccgcttcattagttagcatggagttatccatttttatggttattccgttaacgctattattggggacttttttgggtagcgtaagcggttttatcgttgcaaaaggcaaagtacaggcatttattgccacattagttaccatgactttattacgtggtgtgactatggtttatactgaaggtcgtccgattagtacgggattttctgaaacggcagacagctttgcttacttaggtacaggttatttattgggtattcctttgccgatttggttaatggtaattgtgtttgcggttgcttggtatgttttaaaacactgtaaaatcggacgctatatttatgctttaggcggtaatgaaaatgcaacgcagctatcaggcataaatgttaatagaattaaaatatttgtgtttgcagtgagcggctttttatccgcacttgccggattgatcgtcactgcacgtttatcttcagcacaaccgacagccggtgtgtcttatgaattagatgcgattgccgccgtcgttgtcggcggaaccagtttaatgggcggtaaaggtcgtgttatgggtacattaatcggtgcattgattatcggttttttaaataatgcactgaatttattagatgtttcatcttactatcaaatgatagcaaaagcgttggttatcttaattgcggtgcttgcggataactatttaggtaacaaaaaagcataaactcaatatctttataggagattttaaaatgaaaaaattaacaactattgcatcagctgtcatgttaagtcttgcttttagtggtgtagcaatggcaaaagagacaattgcattagcggtgtcaactttagataacccattctttgtgtcacttaaagacggagcacagaaaaaagcggatgaattaggttataaattagtcgtgttagattcgcaaaatgatcctgcgaaagaactggctaatgttgaagatttaatggttcgtggtgcaaaagtattattgatcaacccgacagacagcgaagcggtttcaaatgcggttgctattgccaatcatcgtaatgttcctgtcattaccctagatcgtggagcggcaaaaggtaaggtagtgagccatatcgcttcagataacgtagctggcggtaaaatggcaggtgactttattgcacagaaattgggtgcaaatgcaaaagttattcaacttgaaggtattgcgggtacatctgctgcacgtgagcgtggtgaaggtttcaaacaagctattgcagaacacaaatttgacgtattagccagtcagccggccgatttcgatcgtactaaaggcttaaacgttatggaaaatttattagcaagtaaatccgcagttcaagctgtatttgcacaaaatgatgaaatggcattgggagcgttacgtgctattaatgcggctaataaaaaagtactggtagtcggttttgatggcactgatgatggtgttaaagctgttaaaagcggtaaattaggtgcaactattgcacaacaaccggaacttatcggtagtttaggcgttgaaactgctgataaggtattgaaaggtgaaaccgtcgcagagaaaattcctgttgacttaaaagtcattgttaaataataaagtgagggcatatttattgtcctcatttcttgatataaacaataagggcgattttgtttattttctgataaggataaatgatgagtaaaactcttactgttcttggtagtattaatgcggatcatgttatttctgtaccgcactttgccaaaccgggcgaaacactaagcggtaaacaatatcatattgcttatggcggaaaaggtgcaaatcaagctgtggcagcagcaagattagcggattttagccaaggtgcaacagtgaattttgttggttgtattggtagtgatgatattgggcgagcgatgaaaaaagcgtttgcacaagatggtattaatgttgcgacaattactgaaattcctaatgaaatgactggaattgcaatgattcaagtggctgatagcggagaaaacagtattgtcatttctgccggtgcaaatgcatatttaacgcctgagattgtagataaatttgcgacagaaattgagcgggcggattatttactcatgcaattggaaacaccgttgaacgcaattttggaagcagctaaattagctaagaaacatggtgcgacagtcgtattaaatcctgctcctgcgagccaattacctgatgaattgctcagtttattagatatgattacgccgaatgaaacagaaacggaaattttaaccggtgtgaaggtaaccgacgagcaaagtgcagcgaaagcagcgagtgttttgcatcaaaaaggtgttgctactgtgttgattacgttaggttcaaaaggtgtttatgtgagtcggaaatcttcgacacaagaactggggcagaataaggttatagccggattcagagtaaatgctgtagatacaactgcagccggtgatacgtttaatggggcatttttgaccgcacttttagaaaataaatctcttgacgaagctattcgttttgcacatgcggcggcagcgattagtgtgacgcgtcaaggggcacaaccttccattccaactcgtcgagaaacattagactttttggcacaacattaattaatgtaagggcgttgaagatggctacaatgaaagatattgctcgaattgcacaggtatcaacgtccactgtttctcatgtgattaataattcacgttttgtcagtgaagaaattcggcagaaagtcatggcggtagtggagcaactgaattatacgccctcagcattggctcgcagtttgaaagtcaaagaaactaaaacaatcggcatgctggtaactacgagtgataatcctttttttgctgaggttgtggcgagtgttgaacgttattgtcgccaacatcattatcatttgatcttatgcaataccaatgatgacagtatttgtttgcaagaaaatctgcaaaatttgatacgcaagcaggtcgatggattgctcttgatgtgtacggatagtgcctttgaaaccagtcctttaaatttaactgttcctactgtcatcatggattggtggccgacagagctaagtgcggataaaatttttgaggattccgagctgggcggatatttggcgacacggactcttattgagcatcaacatcatgatattgcgattattacgggaaatctgaaaaagcctcttgctcgtaatcgtttgaaaggctataagcaagcgttgcaagaatacaacattcctattcgtgataaatggattattgaaagtcattttaactttgaaggcggaattaagggaatggaacagttgttacaattgaaacagcgtccaagtgcggtgtttgcttgtagtgataccattgcagtgggtgcttatcaagctgtttggcgtcatgggttatctgtgcctgaagatatttccattattggttacgataatattcatttagcacaatatctttctcctccactaagcaccgttcatcaacctaaagatgaattcgcacacttggcagtagatacattgttgcaacgaataaaaaatcctaccgaaaattaccgcacgttgacgttaaaacctgagatagtattgcgtcaatctatttgttcctgttttttgcctaagtccgcatagaaaaaagaccgcaagtgcggtctattatttatctccaaaatttccaccagcttgtgcgttttgcttccggaccttgaatgattgtattattgatatattctttttcaacatcaggtagcggtttatctaaattaacgtcggtgacaataccgcgtcgatcaaaattcacaataaaagtatgttgctcaggtgcattataagatttttgttgtaaaaatacgtagtaccaagtttgattgctaaatggatctattagcattggcgtaccaagtaagtactgaacttgttgtgcattcatgcccactttcacttgttctacagcggtagattctaaatagtttccttgtggaacatcaatacgataaacgattttttgaacactggaacaagcggtaacgcttaatcctaaaatcatagcaggaataataaattttaatcgcatattttgtttaccttaactcgtgcaaataacgtcgtggataataactaaaattcgtaaaattgccaacttattcttttgtttggcgttgtagttgatcgcgtaaattcggcggtagtcctgtaatggttaaactatccgttgcttcatcccaaaatatacgactgtttaataactcggcatcaaaacttaatgtgataccttttcctgagccggaaaatttagtcagcgattttaatgcagtacgtacgggaggaatattttcttccaagccataattttggctgacagcgaaatcaacaaaagactgttcatttagagtgggtatattggcagaaagttccctgacaacgatttcttcgcctacatttatttgtcctttacaataatcgaatacttgttttttgaccgcttgagtttgttcttttgtcaaatccgcctgttggcagtagtcactaactgcttgtaataaacattgattttgcacttgaggatttaatccctcttctgcacctaaaaaatccataaaaaagtcagcaattttgcgtccaactcgacctttaataaaagtcagataacgagttgattttgcatctaaatgcaattcggttaaattaattcggcaagcaatatcaaattgagtaatatcaagataatgcgtttgttttatttccagattttcatcaaccaacatactatagcgactatctaataatgcgatgaataaataatctgttgcgagaaaattgtattgacacaaaattaacgtgccatcattggcaaaactgtattttcctagctcttgacgtaataattcggctgattgatgactaaatgccaagaaatcaatatcgttttccaatgtgcggttgagtatttgagcaaaatttgaggtttcttggaatactccataggcttttgttttattttgatactcttgatgtaattgcaacatcatttgttctgtttccgctgtaattggtaataattcatcacgtaaatgcgttttaagttgaacggtattttcatcttgtgatgttttaaccaattgatgcaaaacaatttgattgactataatgctcattttgttcaaatcctgtttatgataaaaattcttaatattataaccgcactttaaggaaaatatgctagtatgtgtccaaattattcgtttctatttatatttagcgtacaaaattaaatggcaaaaatttcaaaatttcaagataaacaagttgaggcaatattgaatgatatgatcgctatactggaaaagcatcaagctccggtagatctttctttagtcgtattgggcaatatggtaacccatttgttaaacagtagtgttgggtcgcaacaacgtattgtgttggcaaaagtattttccgatgctttaatgaattcagtaaaaaatagtaaataatatgtttggaattaaaacaagcaagcaatatcgtgatgaattatctcgtaagattacgtggggacattggtttgctttttttaatattttgtgggcaattgttattggtagtcgttatgcctttattattgattggccgcatactttattcggtaaaatatatttttttattagtttattggggcatttcagcttcattgtttttgctctctatttgctcgctctctttcctctcagttttattataaaaaatgaacgcacttttcgtggtataagcgttattttaacaacgataggtgcaaccttactgttggttgatacagaggtgttttctcgttttaatttacatctttcaaccctcgtttggaatttgttggttaatcctgatgatggtaagttatcttataagtggcaaatattttttgcacctatgccattgattttatttgttcaaatgcttttctcacgttgggcatggtataaattacgcagtttagagagacaaaaatggattaaaggtgttgctcttgtatttgttgttagctttattgctacacatattctttatgcttgggcagatgcgtatatttatcgcccgattaccatgcaaaaatcgaatttccctctatcttatccaatgacagcacgttcatttctcgaaaaacatggtttcttaaataagtctgaatatgaaaaaaccttaaatgagcaaggtcgtcttgatgcgttaaaagtgaattatccaaagcagaaattgactttttccgatgagttgccaaagacgaatattgtccttatcactattagtggattacgccatgatgcagttcgacaggatataatgcctaatttatttgcattttctgagaattcaactgaatttactcatcattacagttcaggaaactctcttaatcaaggtttgacaggattgttttatggattgaatgctaattatgcggacagcttacttagcaataaaacaacacctgtattaattgagcagctaaaacaaggaaaagtgcggtatgaaatcggtctatttggtcagaatttatctcgaagtgtattattgaagaaaagtatttttgcacatgagaaaataagaaatgacaacaatgcctctacgtggcgttttattgagtttgttaatactcgacaacaacagcaaaaattattttttgcctatctaaattattcactgaacagcaatttgactattgaacaatattatcaaaagttatctgaaattgatgatgagattggttcggcatttaagtcgatagattttactcataccattgtgatagtgacttccgaatatggttatagttttgatttttctgataaaaaaagaccaactaattattttgcaagagaagtaattcaagttccaatgattataagatgggaaaatttaccgatcggtaaagtgaataaattgagtagtcataccgatttggtcccagccttaatgaaacatatttttaaagtaaaaaatccaattagcgatttttctcaggggcaggatttatttgatttggatgataatcgtagttgggttcttgctggtaattaccggtggaatgtaatcattacaccggatgattcgcaatatcatattgataggaatgggcattatcaaaaatacaatcaacattatcaaaaaatttcgtcaacacaacctccgttaggattattcttggaagtattttcacagaatacggctttcatcgaaaaatagatttattagagataagccgttttccgagatgagaatgctaagagtggaagcgtattctgttttataaaaaaaagcgtttcttttgtgggggaagaaacgctgaaatgttggagtgattatctattattgtttgagtgatatagatgataattgttctcaaataacttgtcaataaataaataaaaattattatcaattttttttcttgtctttaattattctaggtaactcactaaatttgttagataaagtgcggttggtttttgatgagaaaaatcaaatttcacggcatagctataaacttcaacaccttctttaactgcttgctgcagtaattcggcataaacaggatcaatagattttgcaacagtgaagcgattaaaaccgtcgtgaagaccggcgaaaaaaacgaccgctctatgtccccgctttttcattgctataagctcacgcaagtgtttttgtcctcttgttgtgacggcatcagggaaaaaaccgagatgatttttgacaaacgtaacggattttacttcgacataacaatccggtaagtttttaccgttgagtaaaaaatcaatgcgactactttctacaccatattttacttcaggcaaaatctcatcatattcagctaattctgtgatgattttattttgcaaagcctctaaagttaattgattggaacggtgagtattgatacataccgtttgaccatttttaagttgagttaattcccaagagtgcgggtattttcttgttttgctgtcagaagtagaaaaccaaacagtatcgcctttttcaccacatcctgtcatcgcaccggtattggcacaatgaagtgttaaaatttcaccgttgtttaattctacatctgccaaaaagcgtttataacggcgaagtaatgttgctgattgtaaatttggtaattgcataaaaatccttgttatccaacagtttcagtaattttaccagctttatctgaaaaaaatttggattgaagcaatagttgaaatttttaagaaaatagctttatttttagcgaattaatggtacatttactccgcttgactttttgtcatcttaaaggatgggcgatattatctcccaatttttttaatcaatcaatttgaaggaaacattatgttaattggtgtacctagagaactgcttgataatgaaagtcgtgtggcggcaacgccaaaaacggttcaacaaattttgaaacttggttttgaagtgattgttgagaacaatgccggttttaatgcgagttttgaagatcaggcgtttgtaaatgcaggcgcaaaaattggttcggcacaagatatttggaatgcggatattatttttaaagtaaatgcaccgacagatgctgaaattgcacaaattaaagaaggtgcaacgcttattagctttatttggcctgctcaaaattcagagctaatggcaaaactttctgctaagaaaattaatgtgttagcaatggatgctgtgcctcgcatttctcgtgctcaagccttagatgcgttaagttcaatggcaaatatttccgggtatcgtgctgttattgaagctgcacatgaatttggtagctttttcacagggcaaattacagctgcaggtaaagtacctcctgcgaaagtacttgttattggtgcaggggttgcagggcttgcagcaatcggtgcggctaatagtttaggtgcgattgttcgtgcatttgattcccgtccggaagtaaaagaacaagtgaaatcaatgggagcggacttccttgaaatagatttccaagaagagggcggtagcggtgacggttacgcaaaagtcatgtcagaagaatttaaccgtcgagcgatggcactttatgcggaacaagcaaaagaagtggatattattattaccacagcagcgattccgggtaaaccggcaccacgcttgattactaaagaaatggtggattccatgaaaccgggtagtgtgattgtggatcttgctgcactgacaggcggaaattgtgattatacgaaagccggtgaaattgtggtaactgaaaatcaggtgaaagtcattggatatacagattttccaagtcgcttaccgacgcaatcctctcaactttacggcacaaacttggttaatttattaaaacttttatgcaaagaaaaagatggcaatatccatattgacttcgaagatgtggtattgcgtggtgtaaccgtaattcgtgatggcgaggttacttggccggctccgccgattcaagtgtctgcacaaactcaacaaacaacaaccgcacctgttgtggataaaaaagaaaaaacgccaataaatcctaaagtgaaatatggggtaatggcattggcgggagccgctttcctatggctcggttctgttatgccggctgcatttttatcacactttactgtattcgtattggcttgtgtggtcggatattacgttgtatggaatgtaagccatgcattacatacaccattaatggcagttactaatgcgatttcaggcattatcattgtaggagcattattgcaaattgcacaaggaaatttctttatcagtttgttggcgttcattgctattttggttgcggcaattaatatttttggtggctttaaagtgactcaacgtatgcttgccatgtttagaaaaggttaaggagaggatgcaatgtctgaaggtttagtacaggctgcctatattgttgcagcattactgttcattatgagtttagcaggtctttctaaacatgaaactgctaaagctggttgtttgtatggcattgttggtatggcaattgcacttgttgctaccatttttggaccatattcacaaggattattctggattattattgcaatggcagtcggagccgtcattggtattcaacgtgcaatgaaggttgaaatgaccgaaatgccggaattggttgcaattttacatagttttgttggtttggctgccgtattggtgggctttaatagttttggtttacatgaaaccgcacaatttctggtaccggaaggtgttgaatatgtcacggatgctgctcaagcattattagcacaacaaaaagcggactttgttgcggaacaatctgtattggcaactattcacaatgttgaggtctttttaggtatcttcattggtgcggtaacatttaccggttctattgtcgcattcggtaaattacgcggtattattaattctaaagcgttaatgttgcctcatcgccataaattgaatttggcggcattgattatttctgcgttgttgatggtcgcatttttaaattcacctgataatatcttccctgtattactaatgacagcgattgcacttgcatttggttggcatcttgttgcttcaataggcggtgcagatatgccggttgtcgtatccatgttgaactcttattcaggttgggcggctgcagcggcaggcttcatgttaaataatgatttgctcatcgttaccggtgcattagtaggttcatcaggggcaattttgtcatacattatgtgtaaagcaatgaaccgctcttttatcagtgtcattgccggtggattcggtaatgatgtagttgcttcatcagaggcagaacaaggtgaacatcgtgaaacaacagccgaagaagtggcggaaatgttgaaaaatgcaagctctgttattattacaccaggatatggtatggcagtggctcaagcacaatatccggttgcggaaattacagcaaaattgcgtgaacgtggtgtgaatgttcgctttggtattcaccctgtagccggaagattaccagggcatatgaacgtattgcttgcagaagcgaaagtgccttatgatgttgtacttgaaatggatgaaatcaatgaagattttgcggataccgatgtcgtattagtcattggtgcaaatgacacggtaaatccggcagcaatggatgatccgaacagtccaattgcgggcatgcctgttctagaagtttggaaagcggctaatgttgtcgtattcaaacgctctatggcggtaggatatgctggtgtacaaaatccgttgttctttaaagaaaatacccaaatgctttttggtgatgcaaaagagcgagtagaagatattttgaaagcgttataacaagagaaaaactggtatagaatataactgcactttgctaaaataaagtgcagttatttttttacatttaggaatatgttatggtgcaatatgccttgctcattttgtttagccttgcttcaataatttttattattaactcccattatcgttggacatatttttttgcaataagtcaatttttgttatttattggcattatgtttactattacagggcaatggcaaagagcggttaatttttcttctacattattcattgtttttgtgttgtttcatcgaattaaaatccatttttataagcaaccgcttttgatttcagatttctttttagtcatagattggcgaaattgggaaaccttgttgcattatcgtcaggctttttttgctattatggggctattggttttgttggcttatggtatattcggttggcaaaatacccccgctcttcctttttattggcagataatatcaggcttaatttctattattttaattgtttcaatttgtcattgtacaaagaacaagcaagctatcaagcaatggttagattctttacctgatgatggaagagatgtatttcttaatttacctatgtcctgtcgaggaatcttttataaatcgccggtattttctggaggtagtcaatattttcttgaaaaagcagaatcaattgaaagccataaacaatcaaattcggagcaaaaagcagatattgtagtttggttacaagaatcaacgttaaatccgcatagttttctttttaaacagcacaatattccacctatcacaatgtatgaaaatcaagatgatacaaaatgtaattctcatctgcgagtacataccttaggtggtgcaacttggaaatcagaatttgcatttttatcaggattgccctcaacagattttggtgcaatggctaatgcagtattttattctgtcgttcctcatctaaaatacagttttgttaaaaatttaaaagcacaaggatattattgtgttgctctatctccttttactaaaggaaactataatgcgaaatctgcctatgatcattttggttttgatttaatgttacaaccgcaagatttgggttatccggctcccttaagtaagaatttatggacaatcggtagtgatgaaatgagtcagtatgttcagaaaattcttgataaaaaagatgtgcctcaactaaaagatttacaaaaacccttatttgtttatgtattaacaatgcgtgaacatggtccttattacaactgcggtaatatttttcaaattcaaatggattgtgcaacggagcgagggatcggggaattaaatgattatattcaacggattgtaaatttgaatcaagttatggaagattttaatctttatatgcaacggagaaataagccttatattttaggttattttggcgatcatcaaatttcaataaaagaagctgtaccaagttacagttttaattatccttatccggaatatatcacgcaatttgcggttcgcagtaatttagaaacggattttgaaaagcacgattttttagatttagcatttatagcaggagctattttagaaatagcgggattgcctgtcgatgaatttatgcaaacaaatattaaaatgagaaaattaagtggaggtaagttacaggactgtactgatcaacaattattagagtcttatcgccattatatttattcagaattaaaagtagcggagtagttcattatgaatatgttgcctaattaaaggcgttgctattaaaaggtgtaatgaaaaatggttgctaataatatctttctgaagttattagcaactctttttatttaaaagtccttattgacgtcctcccctagctaaagcaaggagattcctaccagctcccattgcaagcaatgggctactctcggtggtttctgctgctgaccgccaatgcgattcacttcacagacgctacaggcatgtcctgccctgattatgccgtcattgagagtctaaagcgacctctgttagcagtaagaagtatatcatatttgtgccttatatctacgccctaaaggacgtggttttacggcactgtctgataaaaactattttttcttcgcatatttcaaggaatcaattgcaacggcaaagataataattgaacctttgataatatattgccaatatggatttacaccaatataggttaaaccatagttgatgacagtaaaaattaatacaccggttactacgcctagtacagtaccaacaccgcctgcaaaagatacaccgcctacaacgcaagctgcaatggcatcaagttcatacataaaacctagattgttggtggcagaaccgatacgtcccgcttctaacatccccccgaaagcgtagaatatacctgcaatcatgtaaatgacgacaaggttacgagtaacgttaacacccgatacttttgctgcttccggattaccaccgatagcgaaaatgtttttaccgaaacgtgttttattccatagtacccatacaaagaaagaagccaaagctgcatagattgtaatataggaaagcttgaaagaacctatacggaaaaagccttgagcaaatgtagagaaactttcgttgaaccctgcaataggtgaagaaccgacagcatcataatagagagagttaataccgtaaacgataatcatcgttcccatcgtggcgatgaaaggtgtgacatttaagaacgcaattacaaccccatttaccaatccaattattgccccaatcatacagactactatgattacaacaggaataggaatttcaccaagttcagggaaaactctatttatattatccattgcttgtaacagagttgccgaaataactgcagctagaccgacttgacgacccgctgacaagtctgttccttgtgtaactaataaacctgcaacgcctaaggcaataattaagcgaacggaggattgcgttaaaatattactaaagtttcttaaacttaagaaacttgagtcttgcataataataattccgagtaagatcaataacacaaaataaattgcgttttgtttaaggaaatctagcgatttgttttgttttaaagcagacataattcatttccttcctttaaagatattttgccgcaagttgtaaaatttcttcttgcgatgtttttgctgtttcaacaatttcagtaacttttccgttactcataactaaaatacggtctgtcactcccaataattccggcatttctgaggaaattagaatgatccctttatctttttttgccaattccatgattagctgataaatctcgtattttgcaccaatatcaatgcctcgggtcggttcatcaagcatcaaaatttcaggttgtgtgagcaaccaacgcccaataattactttttgctgatttcctccagaaagtgagccaatatgggtttgatgtgaaggggttttgacattcattgcatcaataacccattgggtatcacttttcattttaatggactttaataaaccaaaatgacctaaataggatttcatattagaaatgagagagttaaattctatgctcagatttgcataaatacctgttgagcgacgttcttcggtaacgagagcaaatccattattaatcgcctcaagtgcggtgcgatttttcatttctttgttatacaatttaattgttccacttttacgctcacgaataccgaaaatggtttctacaatatccgtacgtttggcaccaacaagtccagcaataccaagaatttcacctttacgcaattcaaaagaaacatcttgaatggagggttgatttaatgctgtcagatttttgacttcgagaataacttctttgggttgatttgttttaggggggaagcgttgagttagttctcttcccaccatcatggaaactatttcatccatggtagttttttgtacttcaacagtattaatccatttaccgtcacgcaaaattgtgatttcatcacaaattttgaaaatttcatccattttgtgtgaaatataaacgattccacagccacgtttttttagttttgcaatgattttgaataaatgttcaacttctttttctgaaagtgaggaggttggttcatccataatcacaattttggcattgtaggaaaaggcttttgcaatttcaaccatctgcatttgtgatacagataaattcgctactttctctttgggatcaatatcaatacctaactcatcaaaaatagcttttgtatctcgatacatttttccgtgatcaacaaaaatgcctttcaatggataacgtcctagccataggttatccatcacattacgttgacgcaccaaatttaattcttggtgaaccatggatataccgttttccaacgcctcttttgaggttttgaaattaattggcttgtttaaaaaaagaatatcgccttcatctttagcataaataccgaataagcatttcaacagtgttgatttacctgctccattttctcccattaacgcatggactgagtgagatcgaattgttaaattcgctttatcaagtgcttttacgccgggaaaggatttactgacatttatcattgtaagcaatatttcgctactttgatgtagagtttgtcctgtcatatccaacctcatagaaaaggggagtacatatctcccctaatgattacaacaattattttaagaattcatttaagttgtctttatcaatgccgacataaggaatacgaacaacacgtttttctaatttccagtttgttccttctgttgcaggtttaccttgtgctaaattttttgcaagttgaaccactgctttaccttggttaacaccatcatttagtacggtacctgccatttcaccttttttaattaactgtaatacttccggcaaggcatcgacaccgaaaatcgggagttttttaccatgggctttagttgcttccaatgcacccattgccataccgtcattattagaaataataacctcaatttcgtttgctttagagctggataaccaagcatccactttatcttttgccattgcagcatcccacataccagtatcaatgaacaattgttctgattgaataccctgagcattgagtgcttcaattacgtatttggtacgagcttcagcatccggatgccccggttcacctttcaataagacatattgaattttcccatctttatttaagtcataggctggatttgctttccaatgtttcgcaattaaattaccttgaatgagtccggattctttaggatccgtaccgacatagtaagcgtggttatagcttccaattgcttttgctccgggatctttattgaagaagataaccggaatatcctccgattttgcttttttaatgacagttggtgcagcagcagggtcaacaaggtttattgctaatgttttaacgcccttggaaattaatacatcaacctgatcattttgaacagattgtgcattttgtgaatcattcattaacaactctaatccacctacagcttttgcttctttatcgatttcttgacgcattaacgccataaaattatcgtcgtatttgtaaatggttacaccgatacgatcagctgattgtgctgagattgcactaaaacctacagctaaagttaccgcacttaatattgtttttttcataaaatgctccttgattggactggaaaatagatattcttatcgatacttagcctatggtttggcaagccacgacaaggatagccgaaaatgtgtgacaagactgtgatctgtttcacatttatagaaatttatgaaaacgatttcataaaataggaaaattaaggacgttcaactgaaaagcgtcgaactaaagttggattaaattggatatgaacaggttcatcaatttgattgtctactagacttagtgcgagttttgccgcataagttgccattaaatcaataggatagcgtacagtagtcaacttaggaattaaatagcgtgaaatgggcatatcatcaaatccaataatagagaattgtttaggaacttgtatattattttcgttcaatacggaaatagcaccagcagccatactgtcgttatacgcaataactgcggttaaatttgagttataactcaataaattaatcatggctttttcacctccttcaaaatcaggtgtgctacgtgcaattgcatgttcaacagcgtgaagtttatgatgttctaatgctttcaaatagccattaaaacgatcattttcatctgtaatttgatgatttgagccaatataaccaatatgctgatgcccaaatttgatcagcatttctgtagctagaaaggtacctttattattgtctaaacttacacaacgagtttcataaccttgaatgacacggttgatgattaccataccggaaatacgttctaaatattgagcaagctcttgatcacttaaagcttttgaatgaacaactgcatcgtttgcacaataaggtgtctattgcatttctttctttttccgcattgtgatagccaatgccgattaagatacttttttcatgttcttccgcaacgttatctacggctttaactaaaattgcaaagaaaggatcggttacatcagtaacaacaacgccgatagtatctgtatgttgtaaggcaagagcttgagcattggcatttggatgataatttaatttttcgaccgcactttgaaccgctaggcgtgcttttttactggcagaaggatgattattgagtacccgagaaactgtcgcaacagaaactcccgcttgtctagctacgtcatgaattgtaatcatcttattcacccatacggtttaaaatttgcatgaattgccacttatcataaccaaataaattatgtttggaaacggttgttaaactaaaataaaagcgacttcacaaaattattatttatctcaatatttataatttaataattgtgatatggatcacagttaaacaaaatagcgatgtgatagcatagctgaaaattatttgtaatcgtttacatttttgcgataaatatcaagtttgagggtataaaagtgagtgaaatgaccgaatttgttgcgacagaacatccgcatcgtcgttataatcctttgacggaacaatgggttttagtctctccgcatcgagctaagcgaccttggcagggacaacaggaaaaaatagctgatgaaaataaaccttgttacgatcctgcttgttatctttgtccggggaataagcgtattacaggtgagcaaaatccgaattatacgaaaccttttgtgtttaaaaatgatttttccgctttattagaagatacgcctgaaccactaaaaacggatgaccctttatttcaatccagtctagcacgtggcgaaagcagggtagtttgtttttctccggatcatagtaagacgttgccgttattaacggtagaggaaatttttgcagtggtaaaagtttggcaagaacagctggaggagcttggtaaaaaatatcaatgggtacaaatttttgagaataaaggtgcggttatgggctgctctaatccgcatccacatggacaaatttgggcaaatagttttttgcctaatgaagttgctcggacagacaaggcacaacgaaattacttcaataaacaaggttcgattttgttaatggattaccaaaaacgtgaacgagatttgcaggaaagagtagtaattgaaacggaatattgggttgcagttgtgccttattgggcggtttggccatttgaaatattgttactacccaaaattcacgtgaagcgattaattgatctgaatgagacgcaggcaaaggatcttgccttggcattaaaaatgatcacaaccaaatatgataatttgtttgaaacttcttttccttattctatggggttccattttgcaccttttaatggtgaaaagaatgaacattggcaacttcatgcacatttttatccaccgctactccgttcggcaacggtgcgtaaatttatggtcggttatgaaatgttaggggaaagtcagcgagatttaaccgctgaacaggctgcagcaaggttgcgtgaattaagcgatgttcattataaaaataaataaatttaacggagtgataatatgactcaacaaaatccaaaacagcgagcgaaacagttatttagtgaaaaatttaaccgcacttctgaactgaatgtctatgcccccggacgagtaaatattattggtgaacacacggattataatgatggatttgtgatgccttgtgcaattaattatggaacggcgatcagcggagcaaaacgagatgattatttattttgtgtatatgcggcagatttacaagaatatgatgaatttgatttaactcgacctattgaacccaaaatggaagctaaatggacaggttatgttcgaggtatggtgaaatttattcaacaacattgccctgattttcaacaaggtgcggatttggttatttgtggaaatgtgccactttctgccggattaagttcttctgcatctttagaaattgctgtaggtaaattttgtcagcaactagcggacttatctttaacaaatatagaaattgcattaataggtcagcaggcagagaataaatttgtaggtgcaaattgtggaaatatggatcaattaatttccgcattgggtcaaaaagatcattttctcatgattgactgtcgatctttagatattgttaccatacctgttcctgaaaatattgttgtgatgattgtgaattctcatgtgaaacatgatttagtaaatggcgaatataatatacgccgtcgacaatgtgaaatggcagcccaattttttggcgtgaaagccttacgtgatgtatctgtggagttgttcaaacaaaaggaagcagaattaaccgctcttgatcctgaaatagcgaaacgtgccaaacatgttgtgacggaaaatgagcgggttttacaatcagttcaggccttacaacagggagatttgcaaaaattaggggaattaatgtatcaatctcatgattccatgcgtgatgattttgaaattactgtgcctgaaattgattatttagtggagttggcacaggtcgttatcggcaaaaatggtggagcacgcatgaccggcggaggttttggcggttgtatcgtcgctattgcaccgcaagacaaagtggaggcagtacgtcaaattattgcagacaactatgaaaaacaaacaggtttgaaagaagatttttatgtttgtaccgcttctaaaggagtgacgatatgctaattgattgttttgagaaggaacacaagcaaggaatggcaccggatggacaaccttttcgtatttttacgttaactaatacaaaaggcatgaaagtgcaagtgatggattggggggcaacttggatttcttgtcaagtaccggtaggaaaagaagtacgagaagttttgcttgggtgtcagattaatgattatccgatacaacaggtttatttaggagcgagtattgggcgttatgcaaatcgtattgcaaatagccgatttgagttgaatggtaaacgctatttacttaacgctaatcaacatcagcatcaacttcatggtggaaaagggtttcataatgagcgttggtatttagaaaagtgcggtgtaaattccatcactttttctcattttagccctgatggagatcagggatttcccggtaatttacatgcttttgttacttattctttaagtgaaaccaacaacgtgagaattgaatatgaggcaatttgtgatcaagattgcccaattaatttgactaaccatgcttattttaacttgaatgatgctactttcggttgtgatattcgagggcattctttacaacttaatagcgattattttttgccggtggacagtgcgggtattcctaatgctaagttaaaagcggttgagggaactagttttgattttcgtgaggaaaaaccgatcggtttagattttttacaagaagaacaaaaattggtaaaaggttacgaccattctttcttgcttaatccggacactgaaaaaccttgtgctattttgaccgcacttgatcgttctttgagaatgcaagtgttgacttctcagccggctttacagatttatacgggcaattttctatcagctacgccaactcgtcaaaacgggcagtatgctgattatgctggtattgctttggaaactcaatgtttgcctgatacaccgaatcatccggaatggtggaaatatggtggaataacaaaggtgggtgaaaaatattctcataaaacggaatatcaatttatccgttagatttttaagcaaactctattgaaattaagggggagtattcaaaaaactcccttatttttttctatttctcgcttatatttttgttatgtcatacttttcctgatttttcctagttattcgttacaaaatatgataattttcatgggtcaataagacggaaacaatattacagtttatgagtaacgacgaacagattaatacaatcacagaaaatgaaagtaagaaaaatttctttcactctttatttggacgcttttttcagggtgaattgaaaaatcgtcaagaattagtagacgttatccgagattctgaacaaaatgagctcattgatcaaaatacacgtgaaatgattgaaggtgttatcgaaatctcagaattaagagttcgagatattatgatcccacgttcacagattatttttatcgaaaatgatcaggatcttgaagcgtgtcttgatgttattattgcaagtgcacattctcgtttcccggttatcagtgatgagagagataatattgccggtattttacatgcaaaagatttacttaaattttttcggtctaatgcggagcaattcgaattacaaagtttattacgacctgccgttattgtaccggaaagtaagcgtgtggatcgaatgttaaaagattttcgtgctgaacgttttcatatggcactagttgttgatgaattcggtgcgatttcaggtttagttaccatagaagatattttggaacaaatagtgggggatattgaagatgaatttgatgaggaagatgtggcggatattcgtcagttgtctcgtcatacttatgtagtacgagctttgacggatattgatgattttaatgagcaatttaagaccaattttgccgatgaagaagtggatactatcggaggtttgattatgcaagcattcggctatttaccgaaacgtggtgaagaagttgtactggataatttgaattttaaagttacttcggcagatagtcgtcgtattattcaagtacgagttactgtgccggatgagcaacttacagacagtaaaaaacagaatacagaagaatgagaaattaccttgtttatttcattgctattttaactgggggagtgggcgtattagccttttccccttttgatctttgggcaatcgcctatctttcattagcagggttgatttggattgctaaaaaatcgcaaaaaaagaccgcacttctagccagttttttatggggtttaagtttctttgggattggcgttaattggctcaatgtcagtatttatcaatttggcggaacaccgttaattgtgagctatttactggtcattttactggcaggatatttggcactttatcctgtgttgtttacttatttagtacaacgttttagggtacaaagtttagcgatatttcctgcaatttggacattgactgaatccttacgcagttgggtatttactggttttccttggctacaatttggctatactcaacttgacagcccatttgcgaacttagccgctttgttcggtgtagaagggctgacttttttcgtgatgtggataagtgcggtcatttttagtcttatttctcagctcatacaatcaaagaaacaatgggcaattattattacacatagtgtattgcttgttgtgatgttagggctaagtgcatccactgcgttacttaaatttacacaagaaaatccacaaaaatccctaaatgttactttagtgcaaggaaatattgaacagcaactaaaatgggatcctgattatttttatcaaacactcactatttaccaacgcttaattaaccggagtttagatgactcagatttaattatattgccggaagctgccttgccggccttggaaaatcacattcaaccttatttgcaaaccttacagcaacttgctcaagaaaaaggcgttgaggttgtaattggaacgatttatcaagaggaaagtgaggataaattattaaattctatcgtaaatctcggtaacgctgatgaaccttatcatctaaacacaaaaaaccgttatgcaaaacaccatttagttccttttggagaatatgtccctttagacaaaatattacgcccgttaggttcagtttttaacttgcctatgtcaagttttgcgtcaggagactttgtccaaaaaccatttttagcgaaaaatcgccattttactccggcaatttgctatgaaattatttttggttctcaactacaacaaaatttaactaagcaaagtgattttattttaactatctcaaatgatgcttggtttggcgatagtataggcccttggcaacacttgcaaatggcaagaatgagggcgattgaactgggaagacctgttattcgtgcaactaatactggtattacagcctttattgatgcacaaggtaaaatagttgcacaagctccgcaatttactgaaacgacactgagacataaaatcgttgcaacggaaggtatgactccctatgcaatattaggaactaagccgttgtatttgttaatcagtttattagtattatttagaagtctaggtgcattgatacgcaaaaaattgacgcaaggatagaaaaatattattttgcgaacaggttacagctatttttccagattgtagatgcgataagttctgccggttcttttcttaattgacataattcatggaaaacatgaataattcgctctgaacgattgggttgaccttgaaaaccacaaatgggcatatcgggactatccgtttccagtaataaactgtctaaaggtaattttgcaatagtgtttctggttttattggcacgttcataggtgattgtgccgccaacaccgattttatagcctaaatccacaaaacgctttgcttgatcataacttccggcaaaaccatgaattacaccgcacttatttacttttattcgtttcagaaaagtgaataagtggtcgtgagattggcgactgtgcaagctgacaggcaaattaaagcgttgtgcaaaactgagttgaacttctagaaattcacattgctttttccataatttctcgctaatcagatccgattttcctcgttccagacctatttcagcaattgctgtacaagcagcagaaccttgttctaacgcttgggacaaaatatctaaatcatttttactatgctgttcaatatataaaggatgtaagcctaatccataatacagctgagtcgggtaaagtgcggtcatgtttacaatattttcaaaatctcgctgcaatactgctacaatcagtattttctctacatcaacttggcgggcattatgtacgagttgagccaaattttcctgagtaacttgctgtacataatctaggtgtgtatgggtatcgaaaaaatgcataatgatttgatgctggcaatttgaggaacaatattggctacattacgacgaaatccttgatcgactttttgttgaatgatcaaggaaatcgttatctacaagatgggtaaaaattgtaatatgcttgaatgtaacaccgcactttttgatgaaaatgtaccgacaatatttgtcggtccactatcaaaaatattattcaatggtaacagaagtaataattacatcttcaacaggcacatcttgatggaaacttttgtttcctgttttgacacctttaattttatcgacaatatccattccttcaacgacttcaccaaatacagcatagccccattcttgcacaacggttttaccaaacatttcttttgctcgataatcaaggaatgtgttgtctgctacattgatgaaaaattgagctgtcgccgaatgaggatccgatgttcttgccatggcaattgtgccacgtttattgctaagtccattacttgcttcgtttttaattggtgctttagtatttttttcacgcaagccactttccataccaccaccttggatcataaatccatcaataacacggtggaaaattgtgttattatagaacccctctttgcaatatgttagaaagttttccgctgtaattggtgctttttcaaaatttaatgctaatttaatatcaccaaaatttgtgtgtaatgtaatcattttagatcctttgattttgtgttgttataatgatgcttattatttcataaagttgcaataagtgctataaaatcatcactgagcggattcagcgttctggtagattaacgatttcatttaattatagagaacaaacaaatgttaaaaatttttaataccttaacacgagaaaaagaagtgtttaaacctatttcagaaaataaagtaggaatgtatgtctgtggtgtaactgtatatgatttgtgtcatattggacatggacgcacttttgtttgttttgatgttatcgctcgttatttacgttatttaggttatgaattgacttatgtgcgtaatattaccgatgttgatgacaaaattattcgccgctctttagaaaatagagaaacttgcgagcaattggtagatcgtatggttgttgaaatgtataaggattttgatgcgttgaatgtattacgtccggattttgagcctagagcaacacaccatattgcagaaattattgcactggttgaaaaattaattgcacgtggtcatgcttatgtggcggataatggtgacgttatgtttgacgtggaaagtttcaaagagtatggcaaattatctcgtcaagatttaacacaattgcaagcgggagcaagggttgaaatttctgaaattaagaaaaatccaatggatttcgtgttatggaagatgtcgaaagaaaacgaacccagctggaattcgccatggggagccggtcgccccggttggcatatagaatgttccgcaatgaattgtaaacacttaggtgagcattttgatattcatggtggtggatctgacttaatgtttcctcatcatgaaaatgaaatcgcacaatcttgttgtgcacatggaaaccggtatgttaattactggatacattcaggtatgatcatggtggacaaagagaaaatgtctaaatcgttgggcaacttttttactattcgtgatgtgctaaaccattatgatgcggaaagtgtccgttatttcttgttgacagcccattatcgtagccaattgaattatagtgaagaaaatttggatttggcacatggtgcattggagcggctatacactgctttgcgtggcacagataaaagtgcggttgctttcggaggggaaaatttcattgctcagtttactgaggctatgaacgatgattttaatacgccgaatgctatttctgttttatttgaaatggctcgtgaaattaatcgattaaaaaatgaagataaactgcttgccgatggcttggcggctcgtttgagagaattagccggtattctaggtttattggaacaagatccggaagattttctacagacaggctcggatgatgctgaaattgctaaaatagaggcattgattaaacaacgtaatgatgctcggcaggcaaaagattgggcgagagctgatgctgcaagaaatgaattgacggcaatgggcgttattttagaagacggttcaaacggaaccatgtggagaaaaatgtagtgattgaaaggggcgatattctcgcccattttgatacgttacggttagattttacttatcagcagaataatataatttaccaatctcaattttctgacgaccatttgcttcacgccatttgtttgtatctcgtaaagaatagacgcaaccgcagtattcttgttggtaaaaacgttctcgtttactgatttcaatcattcgttgcgaccctccgcctttacgccaattgtaatcccaataaaccacgtcatcatatttttccgctgcacgatgtccacaaccattaatttggttcatatctttccaacgagaaattcctaagcaactggtaaaaacagggaaaccattttcatgggcatactgtgcggctttttcaaaacgcatatcaaagcacattgtacaacgaattccccgttccggttcatcttccattccttttgcacgatcaaaccaattttgacgatcataatctgcatcaatgaaaggaattccccatttctcggcgaagcgaatattttcttctttacgaattaaatattcttttaacggatgaatattaggattataaaagtaaattgtaaaatcaatgcctgaagcatgaatagcttccatgacttctccggagcaaggtgcacaacaagaatgtaataacagtttattatgcccatgtggtaattctaatttggggcgtacgaaaggtgtattcgaatttttacattctttcttacgacgcttttgtgcatcaaagtgcggttgcttttgttcaagtttggttctgtgcatatctattttcataaggcttgtttgataacgattaaatttaggggaataaatgtttaatttccccagtcaagtctaaaaggttttttattcaaatctgataagtatttttactacaatactcaatgtctaatcattaatagtgcctctcaacggataaataagccaaagaaattaatgcttgcttatattggttttctggtaaacaggaaattgaatcaacagctttttgtgcctcttcttttgctttactcatggcataatccaaagatttttgctctgtcataatggcaagtacatcatccaaaaaatcccgttttccgccctgttcgattgcttcacgaattaatgcagattgttgtggtgtaccattacgcattgcatgtaataaaggaagagtaggtttcccctcagctaagtcatcaccgatatttttacccaaagtcgccgcatttgcactgtaatctaacacatcatcaactagttgaaatgctgttcctaagtatcgtccatagtgttgtaaagcaatttcttgttctgcattactttgagctgttatggcggcacattgtgtagcgacctcaaacaagcgagcggttttactataaatcactttcatataattatcttcacttgtctccggatcattgacattcattaattgttgtacttcaccttctgcaatgatatttgttgcatcggacataatttgtaaaatacgtaatgaattgagtttagtcatcaattggaatgcacgtgtataaataaaatcacctaccaatacacttgccgcattgccgaattccgcattagctgtcggatttccgcgacgcatatcggactcatcaacgacatcatcatgtaacaatgtcgccgtatgaataaattcaacaaatgcagcacaagtaataggctcatcaccttgataatttagtgctctggctgccaacaaagcaatcatagggcggatacgttttccaccactttgaacaatgtaataaccaagttgattaatcaaagcaacatccgaattaagttgtgctagaattgtggcattcactttatccatatctgttttaataagagattggattgcattgatattcattgggttcatttttcctatcatgctgaaactatcataaattaagctaaaagtgcggttgattgtacctgattttctgagctttctgaaattaaactctataaaataagatttttttattttcttaaaaagaaaggcttgcgaagaagccgtttttttcgtagaattcgcaacctatttatatgaattttgatgtgctaaatgaaaataacattataagcactattatctagcggagtatttatgtacgcagtttttcaaagtggcggtaaacagcaccgtgtaagcgaaggtcatgttgttcgtttagaaaaacttgaattggcaacgggctctactgttgagttcgattcagtattgatgatcgttaacggcgaagatattaagatcggtacaccagtagtgacaggtgctaaggtagtggctgaagttgtgtcgcagggacgtggcgaaaaagttaaaatcgttaaattccgtcgtcgtaaacacagtcgtaaacaacaaggtcatcgtcagtggttcacagaagtgaaaatcactgggattcaagcataatttcacaggagttatagaatatggcaactaaaaaagctggtggttcaactcgtaacggtcgtgattctgaagctaaacgtcttggtgtgaaacgtttcggtggcgaatcagtattagcaggtagtattattgttcgtcagcgtggtactaaattccatgcgggttcaaatgtaggtatgggtaaagatcatactttgttcgctactgctgatggtaaagtaaaatttgaagttaaaggcgagaaaagtcgtaaatatgtttctgttgtagccgaataattttattgatacagagtgatgccccacaatgtttttgtggggttttttgtttttagaaaattaatactttattagcacagttaccagtgcggtgctattattgcacgagttttgtatttatataggagggcgaatatgaaacagaaaccattactcgggtttatatttgcattgactactgcgatagcttggggatctttacctattgcattacaacaagttatgaatgctatgagtatgcaaactatcgtttggttcagatttatggttgctactgttgcattagctattttacttaaattagcgaacagattacctaagttatcagatctcaatcgttacttttttggactggttatattaggtgttatagggctatccggaaactttagtctgtttaattcctcattaaaatttattgagccttctgttactcaaatttttgtgcatttttcttcctttgcaatgatgttctgtggagttgtgatttttaaagaaaagttaggattacatcaaaaaattggtttagttattctaattattggacttatcttatttttcaatgagcgagcggaccaattatttgatattaacatctattctataggcgtatttttaagtatgtcggcatccttgatttgggtaacttacggactcgcacaaaaattacttttacgccgttttaactctcaacagattttattgatgatttatacagggtgtgcatttgtttttactccttttgtggagattgagcaattgcaaaatctaaatacttttacgctaatttgttttatttattgttgtctgaatacactaataggttatggtgcctatgctgaggcattaaaccattgggatgttgccaaagtaagtgttgtcattaccttggtacctttgttcactattttatttgctcacttattaaatttaatatacccacagtatttttcagcccctgaattaaatacgctcagctatattggtgcgttcattgttgtctttggtgcaatgacctcagctattggttataaatttatcaagaataaaatttaggagaaaaaaatgaaatttattgatgaggcactgattcgtatcgaagctggtgatggcggtaacggctgtgtaagttttcggcgagagaaatttattccgaaaggtggtcctgatggtggtgatggcggtgatggcggcgatgtatatctaattgccgacgagaatttaaatacattgattgattaccgatttgaaaaacgctttgcagcagagcgtggagagaatgggcgtagttctgattgtacaggacgtagaggcaaagacattacattaagggtaccggtcggaacaagagcaattgataacgataccaaagaagtgttgggtgatttaactaaacatggtaccaaaatgttagttgcaaaaggtggttatcatggactggggaatgcacgtttcaaatcttcagtgaacagagcaccaagacagaaaaccaatggaacaccgggtgaaaagcgagatttgcaattggaattaatgcttttagccgatgttggtatgttgggattacccaatgcaggaaaatcaacatttattcgagctgtttccgcagctaaaccgaaagttgcagattatccttttactacattagttcctagtttaggcgttactcgtgttgatactagccgtagctttgtgattgcagatattcccggattaattgagggggcttctgaaggtgctgggttgggagtacgatttttaaaacatttggagcgttgtcatgtcttaattcatttggttgatattgcaccaattgatgagagtgatccggcggataatattgcaatcattgaaggtgaattatttcaatatagtgaaaaattagcgaataaacctcgttggttagttttcaataaaattgatacactttcagatgaagaatcaaccgcacgtgcaaagaatattatgcaacgtttgggtggggaagatgattattacttgatttcagccgcaacaggtaaaaatgtagacgttttatgccgcgatattatggattttattgaagaaaatccacgtcaagaacaagaaaagatagatgctcaagaagtgaaatttaaatgggatgactatcatcaagaacaattgtccgaacaggtctttacagaagatgaccaagaagaggatgattgggacgattggtcggaagacgatgaggaaggtgtagaaattatttataaaccttagctacagaataaaatatgagggtttccttttttatttaaattgaatgttgatattcatattctaagtaggaaactctcagtttttgtagtaagttgtctgagcaaggctgatcttctacagatatatcaccataagatatctacttgtttttcgtgatgagcggttatttttcctacatttttttcgtaaaaaagtaaatagagaaaaattgtttttttaatcagtgtttctacatcagtaactaagatgtctcttccgctaagttattgaaatatctttgccaatcaaaatattgaccagggtctatttttctattcggagatatgtggcaatgtccgacaatacgttgtttggttattaaaggatatgaatgcataatgtctaaagtcagacgttctaaagattgatattgttcttctgtaaacggttgaagattacttccttccaattcaatgccaatagaaaaatcattgcatttttctctcccttcaaatgaggataatccggcgtgccaagccctatcattgaaattgacatattgtgtaatagcaccatcacgagtaatcaaacagtgtgctgacactcgaatgtttgcaatagtggcaaaataagggtgtgcgagaggatcaaggttacctagaaaaaaatcatcaatatacgaaccaccgaattgctctggcggtaagctgatgtaatgaataactaaaagggaaatatcactattttccggacgttgatcaaaatgtggagagggtaattttctagcctctgaaaaccaacctgtgcagatatttttttgtttattgttcataaattattatttttgcgagtcggctcgcagaaaaagtgcggtctatttgtcggtttttttcaatttctacaaactttcacttgccattcggcattgtcattttatttaaaaaaggaaacattatgaaaataacctatattttttcatcagctaaaaaaggatttactctcatagaactgatgatcgttattgctattgtggcaattcttgcaaccattgcaattccgtcataccaaaattatacaaaaaaagctgcaattacagagctgttacaagcttctgctccttatcgtgcagaagttgagctatgcgtgtataacaatgatgcaccgacaaattgtaatgctggaacaaatggaattcaagcggcaatcaatacaccaaaaggtaaagtaaaatcagttagcgtgcaaggtggagccattactgttacagggaatggaaatcttaaagatattacttataccttaacaccaacaggcgatgcttcaaccggcgttacttggagtgcaaattgcaataataaggctgatctatttcctgccggattttgctcttctacgtctacaaactctccttaaaccattaattacggtgggttgtctcaccgtttcatattaattgcactataaaaagaatttttttgcaaaaatattgcatatttattcaaacggtgataatgtttgcgtaaatcaattaataaccaaaacgagatcttttattcaaatgacaattagtgttaaaaatttaaattttttttatggtgcatcacaggcactgtttgatattaatctcacagctgaagatggtgataccgttgttttattgggaccaagtggtgcagggaaaagcaccttgattagaacgttaaacctacttgaagttccaacatctggagaattgagtattgccaataataaattcgatctctcgcaagatattgccaacccaaagcaaatgcgtcaattgcgtcaagatgtaggtatggtatttcaacaatacaatttatggcctcatttgactgtaatggaaaatcttattgaggcaccgattaaagttttagggatagcgaaagaaaaagccaaagaacaagctattgaattattaaaacgattacgcttggaagaattcgctgaaagatttccactgcacttatcaggaggacagcaacagcgtgttgctattgctcgtgcattaatgatgaagccgcaagttttattatttgatgaaccgacagcggcattagatcctgaaattacagctcagattgtatcaatcattcaagagttacaggaaatgggcattacacaagttatcgtaacgcatgaagttgcggtggcaaaaaaggttgcaaccaaagttgtctatatggaacaaggtcgcatcgttgaaatgggggattccagctgttttgaacaaccctcaacagagcaatttaaacaatatttatctcactcacactaatatttaaggagcttattatgaaaaaattacttttagcaacaatgttggcagctgctacgattggtgcaaatgcacaagatattacttttgctatggaaccaagttatccaccatttgaattaactaatgaaaaaggtgaaattattggttttgacgttgatattgctaatgcaatttgtaaagaaattcaagctaattgtagcttcaaagcccaagcgtttgatgcgttaattccaagtttaattaaaggtcgcggtgggtttgatgcggcaatttcagcgattgatattacggaagcccgtgcaaaacaagtagcatttaccgattcttattatgaaagttctgccagttttattgcattaaaagggaaagcggatttaacgacggcaaaagtggttggtgtacaaaacggtacaacgtatcagcaatatgcgaataaagaagcgaagcaatatcaatctaaatcttatgccagcttacaagatgcaattttggatttaaaaaatggtcgtattgatctcatttttggtgatacggatgtattaagagatatgtttgataaaaatccggaattgcagtttgtgggcgagcgtgtaacggataaacgttatttcaataacggcttgggaattgcggtaaataaaaagaataccgcacttgttgagcaattaaataaaggtatttcggcaatcaaagcaaacggcgaatatcaaaaaatttatgataaatggatgactaaataattttatgtttattgattatttacctttaatgtataccgcaaccctgatgaccttagggttggcggtttgttctttattactcggattggcattatctattttctttgtagtattagaaacacacaaatgggcatgtattcgtaaaccgacagccactattgtgacattattacgagggttacctgaaattcttgtggttttcctaatttattttggcgtacctgaaatactggaatgggtaatcggagaatatgtagagtttggtgcctttggttgtggcgtggttgcactgtctattatttttgcttcttatgcttctcaatctttgcgtggagcaattcaggctatacctttaggacagtgggaatccggtgcggcattaggtttgagtcgtagttatacgtttatttttcttattatgccgcaagtttggcgacacgctttaccgggattgagtaatcaatggttagtgttattaaaagataccgcacttgtgtcgttaatcggtgtgcatgacctaatgcgtcaagctgaattaatcaataccaatactcaccaaccttttacttggtatggatttgcagcattgctttatttgttgattacgctatttagtcaatttattattcgtaaacttgagcggcgagtcacacgctttgaacgtgctacaaattaaaggatgaaaaatgattaaagattattttttaacaattgcacaaggaattccaacaagcttaattcttactatagttgccttgctggtagcattttttcttgctttgacattaacttttgctctttctatggaaaaaaaatggttaagtcttccaattaatctttttctcacaatttttactggtacaccattactggtgcaatttttcttaatctatgcaggaccgggacaattttcttggattgtaaatagttttttatggcctttattatcaagtgcgtggttttgtgcaatacttacattagctttaaatagtacagcgtattcaactcagcttttttatggtgcggtaaaagcgatttctaaaggacaatgggaaagctgtgttgcactaggtttgagccgttggcaaactttgaaaattcttgttccttacgcattaaaaagagcattaccttcatatagcaatgaaataattcttgtctttaaaggcacatcgcttgcttcaattatcactattttggatattatggggtatgcaagacaactttatggtactgaatatgatgcactgacaatttatggtatcgcaggcgtaatctatctcattattacaggtattgctactttattattacgcagattggagcgtaaggtgcttgtatttgagcgtttagaaacggagcgagtgtaaatacataataacaaataccgaaaagtgatctgtgccttaatttatcgtttatgagttatctatttaagatttaaggaacagatcaatatcggtaatcaccaattgctatttcgtatgaagttttgccaatccgatatcacaacttttgatttgtatatcatgctccatggcgagaatttgttgcttactttgttttaatttactttttatttttgccagttgaacatgtgttcccggctgtttttctgcctcagcaattagattttctgtttctttaaataatttttggcactgctcaggcagagtgtttgcttggacatgagttgttgttatagttgcaaatacgctagctaaaataatcattactgatcttggttttagcattatattcattgataacctcttgaaattttttcagaaaaccttcggaaactatcaaaaaaagactgacatgtctagttatttattgcttcatatttttttgtaaatttttactatttggaataaatgttaaaaattgtgaatattctataatgtttgatgtatatcaatatataagaaagtgttaaagaaatgttatttgatttagatctaaaaatgtgatctttataacacttttattgttttttattcttacttttagtagtaaaattaataccgtttttgggttatccacatgacatttaatggtgaactgtgaaacttatgtaaattttatgttgtatgttcatttaaataaatgtttatgaggatagttcagtaaatctacttgaggtttcaacttgagtatttgaggggtggttacatagtaatcattgtgaaaaacttgtagcattgcacaaggagttggagatgttggacgttgttgaactctctagattgcagttcgcgttaactgcgttgtatcactttttgtttgtaccgctaacattgggtttgtcatttatccttgtgattatggaaactttatatgttgcaacaggcaaagaagtgtataaagatatgaccaaattctggggtaaattgtttggtattaattttgccttaggcgtgacaactgggattacaatggaattccaatttggtactaactggtcatactattctcattatgttggtgatatttttggggcaccgctcgctattgaagcattacttgcatttttcttagaatcaacatttgttggtttatttttctttggatgggatcgtttatcaaaagctaaacatttattaactacatattgtgtagcatttggttctaacttttcggctatgtggattttagttgccaatggctggatgcaaaatccggtagcgtctgagttcaattttgaaacaatgcgtatggaaatgaccagttttatggatctttggttgaaccctgttgcacaaagtaaattcttgcatacattgtctgcgggttatgtaactagtgcatgttttgttttagctattagttcatattacctcctaaaaagacgtgatgtcggattcgcaaaacgctctttctctattgcatcagttttcggtatcattgcaactgtttcagtattgatcatgggtgatgaatctggttacgaaattggtcaaacccaacctgtaaaattagctgctatggaaggtgaatggcatactcaaccggctcctgcgtcttggaatatgattgttgtacctaatcaggcagagcaaaaaaatgattttgctttacaaattccttatgctgcggggattattgttactcgctcattagacaaacaatttacaggactagttgatctacaagctcttaatgagcaacgagttcgtaacggtatggttgcctatggtttactacaacaattgaaggctgagaaaaaggccaacggtcaggttaatgaagaaactaaagcacaatttaacgcagttaaagatgacttaggatttggtctattactcaagcgttatactgatgcggttgtagatgcaactgatgagcaagttaagcaagcagctgctgatactatcccaaatgtaggaccaacgttttggtcattccgtataatgatgcttgccggtggtttaattctagttctgatgattgctgcattcgtacaaaatatgcgtaaaacagtagggcgtagtccacttttattaaaagctttattatgggggcttccacttccatggattgctatggaaagtggttggttcttagctgaatatggacgtcaaccttgggctatttatgatgtactaccggttggtgtggctgcgtcaaatttaacaacagctgatctttggttatctattggactgatttgtgccctctatacaatcttcctagtagtagaaatgtatttgatgtttaaatatggtcgcttgggtccgagttcgttaaaaaccggtcgttattattttgaacaattatctaaataagcaggagtctaaccatgattgattatgaatttctacgttttatttggtggattttagtcggggtactgcttattggatttgcagtaacagacggatttgatatgggagttcttagcttattacctttcgcaggcaaaaaagaagttgagaaacgtataatgatcaattctatcgcaccacattgggatggaaaccaagtttggttattgactgcaggcggtgcaatgtttgctgcttggccgatagtttatgcagcctctttctccggcttttatattgcaatgattttagttttagccgcactatttttccgtcctgtcgggctagagtatcgtgctaaaatcgataatccaacttggcgtaaattttgggattggggattatttgctggtggttttgtcccatcattggtattcggtgttgcattcggtaatttattgcaaggtgttccatttgaatttaatgatttgatgcaagtaacttatacaggttctttctttgaattattaaatccttttgcgattctttgtggtttaatcagtttttctatgttaaccacacaaggtgctgcttggttacaaatgaaaacaacatcagaactgcgtgagcgtgctcgtgtaataacacaagtaggtgcttttgttacattgttgacgtttattttggctggtgtttggttatatttcaaagaaggttttattgtaacaagtgtccttgatcataatgcaccatctgacccaactgttaaaacagttgcagttgaagtgggagcttggtttaagaattattttgatgcacctgtgttgtttattcttccagcattagcagtgggtggtgcgttgttaaatattttggcatcaaaagccaaccgttcaggatttgcatttttcttctcgtctatcacgatggcaggaattatattaacctgcggtgttgccatgttcccatttgttatgccttctatttctcatccgaatatgagtttattaatgtgggattcaacatcaagtgaattaacattaacactaatgcttggttttgcactgttctttgttgttattttactgagctacaccatttgggcttatgcgaagatgtttggtcgcttagatgctgacttcattgaagaaaacaaaaactcattatactagtaaggagataagattatgttttatgtgttatgggtagtgggtgttttgttcgctgttatgctaagtgcaatcattactatcggtcttgagaagactggtaaactcgacgaataaagagttttctttatcaactgaaaaataagggcttttaaagagccctttcatttcttctgttgtgtaaatttttcatgatcaaaagtaaaagtatttttaactaagcactgggtttattttaaggtgcgatgtatagtctaaaaaaatatttttcttttcactgtatttattcttgctaatatatttgactgaatctagaatacttggttcatttttcatatagaaatgagaaaataaaagactttgtgagggagagtaatatgcctgtttttaaattgcctgttcgtgtgtattacgaagatactgatgctggaggtgttgtttatcatgcccgttatctccatttttttgaacgggcgagaacagaatacttgcgaacattgaatttttctcagcaaaacttattaaatgagcgaaaagttgcttttgttgtgaagtcaatacagattgactactgtgttcctgcaaaattagatgacctattaattgtggaaacttatgttgtagctattaagggagcaagtatagttttttcacaaatattgaaacgagatgatgagatcatttcacaagctgtggtgaaagttgcgtcagtggatcttgtgaaaatgagacctgtggctatacctcaagaaataaaagcagaaattaaactaaatgataacattttcggagttatgtcatgaccgctgaattagattttttagaattatttttaaaggctagtattgttgtacaaatcgtaattgtgatattaatatctttttcgattatatcgtgggcgattattatccaacgtagtcgcattttaactcgagcattaaaggacagcacactttttgaagaacgtttttggtctggagaagatttgtataaattatatgatggactttctaatcatcgtaatggtctaaacagcagtgagcgaattttttatgttggatttaaggagtttaatcgtctgaaacaagctaatccggatgcccctgaagccattattcaaggcagttctagagcaatgaatttagcaatgaatcgtgaagtggaagatttggaaacacgagttccgtttttggcaactgttgcgtctattagtccatatatcggcttatttggtacagtatggggaattatgcatgcttttatggcattaagtggtgccaaacaagcaacattacagatggttgccccggggattgctgaggctttaattgcaacggctattggtttatttgctgctattccagctgtaatggcttacaatcgtttaagtctacgtgtgaataaattagagcaaaattatgctaacttcattgatgaatttacgacaattttacatcgtcaagcatttggtaaaaatcattaaatgtatcaaaattctccgtactgacggataaagtgcggttcttttttcataagtttagaggctatctatgtcttatcgtcgaaaacgtcgagatattaagtcagaaattaatattattccttttttggatgtcttattggttttattgctcatttttatggcaacagcaccgattattagtcagagtgttcaagttgaacttcccgaggctgtagaaagccaaaatgtatctaaagaagataaaacgcctgttattttggaggtttcaggtattggacagtatgcactttccattggtggggagcgaactgagggcataacagaagaattagtaactcaactttctaagcaagaatttgacaaagataataatacgttatttttggttggaggggctaaagatgttccgtatgaggaggtaatcaaagctttgaatttacttcatgttgcgggaataaaatctgttggattgatgactaatcctctttaaatataagtaggtaacacagtgtgtaatcatcgacaaaaaaatgagcttggtgccattctgctatcaatttttctgcatattttgttattaagtttgctggtattaggctctaactataataatgttgaaatcatgggaggtggagaaggtgatggtgaagtaatgtctgctgttatggttgatacgggaaccattgcaaaagagtggggacgtttacaggaaaagaaaaaaagcaatccggataaacaagaaacctttgttgaagcaacgcaagaagacgagttaatggagaatgttgatgtatttgaagaaaaaataagagaagatgaagaggtacagaaaagacttgcagagcaaaaaataaaagaagaaaaaattcagcaagagcgtttagcaaagcaattggaagaagataatgccaagaaagaggctgttgcaaagttgaaagcagaggctgaagaaatgcgtttacaggcattggcaaaaaaaattgaagaagagaaaaaggttagagacgctgaggaaaaacaaaaagcagagaagttagcgaaagagagagcagagaagttagcaaaagagaaagcggatagattggtcaaacaaaaggcacttaaggaagcaaaaataaaagcggaaaaagcagctaaagcaaaagcggaattagctcaacgcaaagcggaacaagcagcgttagatgattttttcaatggaggtgatattgcaggaagtagcaaaaatggtggaaatgcagcgatgaaaggttctcaaggagtgggtgctggttttgaaaacggcaaaggcggaagaactggagagcaatatgctgctcaaattaagagagaaattcagcgtcgctttctaaaagaacctaggtttgctaataaagtttgtgttattgaggttgaattagcaagagatggaacgatcactaactttagaaaattatctggctcagacgatatttgtactgcggggttatcagcggtatctagaacgaaaaaggtaccggaggcaccaactgatgagatttatagaaaatataagaaatttccactcgaatttagattgaaataattaaagaaactaaaaggtaaaatttatatgaaattttctgcatatttaactacattattcatagtgctttttagtttgttcatacaaaccgtacaagctgaaagtgaggtaagaattgtcattgatgaaggggttgatagtgctcggcctattgcgataattccatttaaatggaatggtagtgactctatgccgatagatgtagctgatatcatttctgcagatttacgcaatagtggtaaatttaatcctattgcagtcagtaaaatgcctcaaaaaccgacatcagcaagtgaggtaatttccgatgtttggtcttctttaggcattgatgcagtagttgttggacaagttacacccaatgaaaaaggatacagtatcgcatatcaattagtagacactatcggtgcttcaggaaatgcgggagaggtactaagtcaaaaccagtacgctgtaccgaaaaatgctattcgtttaggtgctcataccatcagtgatgaagtttttgaaaagctgactgcaattcgtggtgcatttagaactaaaattgcatacgttgtacaaaagaacggtggctcaaaaccttatcaagttcgtgttgcagattatgatggacataatcaatttattgtttatagtagttcgcaaccattgatgtctcccgcttggtcgcctgatggtagtaaattggcttatgtatcttttgaaaatcgtaaatctcaattaattgtacatgatttacagtctggagctcgtcgggttattgctgcattccctgggcataatggagctccggcattttctcctgatggttcaaaattggcatttgcttcatcaaaagatggcgtattaaatatttatgtcatgaatttaggaagcgggactatctctcagttaactagcggtgcaggcaacaacacggaaccttcttggtcaccggatgggcaatctataatttttacttcggacagagacggcggacctcaaatttatcagatggatgtagttggtaatggtatatcattagtttctgctggtcgggggtatagtggaaaaatctctgcagatggtagtatattagtgatgatttatggcgataatattgttaaaaaagatttggcgacaggtgtgacggaaatgttaagctctactttcttagatgaaagcccaagtatttcacccaatggaattatgattatttatagttctacacaaggtctaggaaaggtgctacaattggtttccgctgacggtcgttttaaagcacgtctaccaagtagtgacggtcagattaaatttccagcttggtcaccatatttaaataaaaactaggagaggttaatgaaaaactttgcaaaattattagtagtagcgggttcagtggcagtattggcagcttgtagctcatctgataacgcatctaaaacaaatgctcaaatgtttggcggttattctgtaactgacttacaacaacgttataatacagtgtattttgaatttgatagttatgatgtgcagggcgaatacgctcaaatcttagatgcacactcagcatacttaaagtcaacaccagcttctaaagttcttgttgaaggtcatgctgatgaacgtggtactccggagtataacatggcattaggtttacgtcgtgctgatgcagtaaaaaactttttattaaataagggtgttcaagctagtcaactttcaaccctttcttatggtgaagagaaaccggcagagttaggtcataatgaagctgcatattctaagaaccgtcgtgctgtattagcatactaatttcttaagccgggtatgatgcccggttttttattgcattttttcagtaaattttgaatttaagtaggtatatttgttttaaatgcctcttttctgccgactattcgttcaaataaacaaaaaataaaaaaattttattgattattaaaataaaaacagtaatatatccgctcgttacaaacaatgagggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccattttatttgtaatatcccaatttatgggtcgttagctcagtcggtagagcagcggacttttaatccgttggtcgaaggttcgaatccttcacgacccaccagtcatgtttaaagattcattcataaaaatattggttattcttatttatcgtgtcttttctgtttgtttctcttaagaggacatatacttaaaattagtcacttttctttttactaaattctatttttgcgatctgtatcgtaattttttttaattatttttacccatttttctagatgagttaaagtgcggtcaaaaataggaaaaaaaatgaaagcattaaaggggtttactctattagaaatattgattgttttactgattatcagtatgacagtaacattttcttttcccatgtggcaaacagcaaatacaaaaatgattttagaaaaagagcaaaataaactctatattttcataagggagctacaagctcgagttgaaaattctaatgatatttggtttttaattgctaatcgtgatttagtgagtaagcgttggtgtctggttgcacaaccaaaaaacacagatatatgtgattgtttaaatcctcgcagctgtaatagaaatattccgatgaaattttattatccttattttgcagataaaaccatgttaatcagcaaagtttattatcctagagaaatgactagattaaatggtacaaggaatacaagtacgacgacttgttttgtgttgcaatctgatcagcaaagaacagtattttcgttttttaatgtaggatctttaaaacttaaaggttaccaatcgttaagtgcttgcgtgaatgatcattagtaagggggaacattgattatttatcgtggacaaactttattaagtgtaatgatagcgttgagcttatcaatgatgttattaatgagtgttagtgcattttatagttatagtcagcaacaaaataaacagatacttttgcatctctatttacaatcagaattgcaacgaactatccaacttttgggtaaggatattcgccgtagtggatttagggctattagtgataaattggttcggagtaatttcgatttatttgaacaagataaaagcggaaagagtattgtagtcgctcaagctgataatgaacccccgaatagttgcgttctttttatttatgatcttgatgctaccggctgtgtaggtacgacatatcgtaataatgtttgtgtaaggaataaacaaaatacagctcgtgaaattgagcgagagttatttggttatcgcttaaataaacaaatgatagagacaagattaacttataaaaattcaattagtgcgaattgtaatcaaaaacaatgccaaagctatttacaacaacctgcatgtaatagcggagggtgggtcgatttattagatgaaaatgacatagccataactgcattaaaatttaattggattgctgattacaatggattggaagtttatctaaaagggcatctaaagcgaaataaacaagtcgaatatgagacttcagctattattcctttgcttaatcaaaagagataaaaatgaatatacaaaaaggagttgtaacgctcaccctattaatgctgttaagctcagtattattaattttacttttttttgatggtgatttgatttcgttgcattcatccattgtttctcaacggaaaatatatttagaacaaagtcttatattacagagacaaagtatttctcaaaaagaaaaactttgtgaaaaccagcctctgaataataatttgaaaagtttgaagatcgaatttgaaagtcgacgaaaaattgaccgcacttctcaatttgtatggtgtgaaagaaaatatttgtttaaaaaaaggccgaaaaaagctacttatgaggcaaggctaagtcagtatataaatcttgagttactggacttatttcaacataaattacattcaccgcctgctattttgccgagagataaagtaaattacctctattgggttgaggaaaaatcagctgaattggagatacaaggtaatattaatgcagttgttattgctgaaggggatttgaagttaacaggaaaaggtaaaattagtggaacggttattaccggcgggaaattaagtattgaaccagcagttaaaattgtgtatcgctcaaaaacaatcatcgatcttatccgatcatatagttattggcagtttgcggagaatagttggtatgattttcaaccattataaatttcctcaacggggtaccagcttgatcacgttattagtcacaatgatgatattttctacattatttttatttgttaatcaatgggttagttatcaaagaaaaagtgcggtaaatatttatctacgttatcaagctttgcaaatcgctgaaaatcaacatcaacgcttatttctagaaccgcattttcattgtccgcataatatcgagcaaaacggttataagtttaagatcaattgtgaaggtaagaatgtacgagtttcttatgcaaatcaacaagtaaatttattgcttgattaattattttgaaaagctatgctaaatgaagttattagaagaataaggaacatttgtgtttactttgtattattccaatcaattggaaacgcaaaaagatattttgttacatttaatggatcaacagccattatcagatcctttccaaaaagaagttattttagtacaaagtggcggtatggcacagtggatacagtggcagattgcagagaaaaaaggtatatcggcaaatttgtcttttcctatgcctgcaagttttatttggcaattatatgttgataatttatcgcaagtcacagcttcttctcaatttagtaaagaaaatatgacttggcgattaatggaaattattccgcattatatagatcaaccggaattttacatattgcgtcaatatttacagcaaagttaccaatcaagtcagcagcgatactaccaattagccagcaaaatagcagagttatttgaccaatatttagtttatcgaccggaatggattataagttgggagcagaataaaggcgtagaaattattcagcaaattcagtattaccaaaaaaatttatctgtctcagaatcatgtttttctcaagttgagcaacatattgtttggcaaggtattttatggagagctttagtatgctctgtgcaaaaagaaacacaaaagaatgttttacatcgtgcacatctacatttacttttcttaaaacatattgccggcgaaaaacctaaaaatttgcctacgagaatttttgtatttggtatttcagctttaccgaaggtgcatttagatactttaagtgcattaagccagcattgcgatgtgcatttattttttaataatgcttgtcgtgaatattggggagatataattgatcagagccattggcaacgtttgaaagtgcgagagcgtataagttggcaagatttccaacaaccacaaaatacacaggcttggttatccgatgagcaaatacatacttttgaacaaaatggatttgaacaaatttatgatgaaaagttacaggttggcaatcctttgctttcctcatggggaaaattaggacgggattatttgtatttactcactgaactggaggctaatgaaatcaatgcttatgtcgaactttcggaaaaaacgttgttgtcgcaagtacaggcactcattttagatttggttccttcgaagcacaagtttttaaatttggcagaaaatgaccgctctttaacttttcattcttgttatagtccaatacgagaggttcaagctctacaagattatttgttacatctatttaaccaagctcaggatttgacacctaaagatgtggtagttatggttgcagacattgataaatatgcaccatatattcaggcggtattcagtcaaggcgaacactatattccgtactctatcgcagacagcaaactttccgaaaatgaccctttagtatctgcttttttacaattgttaaatttaaaagaaagtttattcagtgcggaggaagtgctgacttttttggatcatcctgttattcgtcagagttttaatattactttagaggatttggcacaaattcgtcattgggttgagcattcgggtattcgattcggattagaaaaatatccgcaacaatccttgcaaaattataacgcttggcaggcaggtttagagagaatgttactgggatttgctatgcgggaagaaaatggtctatggttagatacgcttggctttgatgatacctatggattaaaagggcagcttgtcggttatttaaaggattttattactcgtttgtatcaatggcatcaatttttgcaagtagatcacgttattgaaaagtgggaagaacatttaattgaattaatgtcatctttttttgtggtagacggaatggatattccgcaacaatacaaaacaacttttaattatcttattgacactattcaacaattaacggagttgatcctagatagctcttttcagcaagaaataagtgcggaggttatttacgaagtttttgttgaacgcttaaaagatatacctaatagcctaaaatttttaatggggaaagtcactttttgtacgcttctccccatgcgatcaatcccttttaaagtggtgtgtttacttggtatgaatgatggtgattatccacgtcaacaaacgccgaacagctttgatttaatgcaatatcatcgcaaaaaaggcgatcgttttcgccgagatgatgatcgctatttatttttagaagcattgatctcggcacaacagtatttttatgtgagttatattggtcgctctattattgatgatagtgaacgagaaccttcagttcttgttacgcaattgttggattatatagctgaaaatattaacgctcaaggtgatctaagaggacaagatattctgaaaaaatcacttattcaacaacatgcgatgactgcatttagccgagaaaatttcaccaaaagagaccgctctttttctaagcaatggctagtgttggcaaataaaaaagatagtggcaatttggcgaattttttacagccgataaatgatacagagatagttaaagaaatttcattaaatgacttaattgcgtttattcaggatcctgttcggtatttttttgagcaaaaattacgtgtttttttacgtaagacagaacaaaatattgcggatactgaaaattttactttagataatttagagttatatcaaataaaagaagaacttatttatctttctgagcaggaatgggaagacttttttgctcggatgaaaattaagggaattatgccacaaggggcgtttgcaaaaatttatcagcaaaaaacaaaaaatgagatcattacacttaaatctttagttacgccttatttggataaaatatcggaacaaatccctcttgatttacacattgaaacagaatacggaaaggtacgtttaatcggtagcattgactgcttatatcatcaaaaaatgcatcgagtaacttggcgagcatctactatcaaaacgaaagatattatccaaacatggatttatcatttagtacaaactttagcgggagagcctaattcgcaaattgagcattactctttagacagcagactttcttttgaaaaaatagaaaaatctaccgcacttcaacagcttcaaacttatgttgaggcatatttacttggacaagtttcagtgttattaatgccaatgaaaaatttcgatcaatatcttcaattgctttttactccgaagagtaataaatggaaagaggaaaaagatattgatttatctgcttgttttgaattgttatcagaacttggctcaggtagaaaagagagaaatttttatgtgaaaacagatccttattggcaaagaatattagcacaaacaaaactagacgattcacatattttagaaattaatcaacgtgttatacaatggttcgatttaatgttaatgctaaaaagagttgaatagaaaataaaaacaaaactggatatttatccagttttgttttatccttagtgctttattttacgctatgtaaggtgagatatgattgggcgtgtaacaggaatactggttgaaaaacaagctccggaaattttactggatgttcaaggtgttgggtatgagttacttttacccatgacaagtttttataatttgccggaagttgggcaggaaactacgttgtttacgcattttgtagtgcgtgaagatgctcatttgttatttggatttagccataaacaagaccgctctttatttcgtgaattgattaaaaccaatggagttggaccaaaattagctttagctatcctgtctgcgatgtcagtgaatgaatttgtgtatgcgattgaacaagaagaattatctaaattagtcaaaattcccggagtaggaaaaaaaactgctgaacgtttattggtggagctaaaaggtaaatttaaaggcttacaacaaacagatttctttattaaaagctctcatttacctggaattaaatgctcaaaaccggatcaaagtttgcagttggatgaagcagtttctgctttaattgcgttaggatataagcctattgaagcagagaaaatggttaaaaaagtgttaaaagcagatttaactagtgaacagcttattcgagaggctttgaaagccgcattataagagatagagaatgattgaagtagatcgcattgtaagtgccaatgcaaaagtagacgatgaatatattgatcgtgcaattcgccctaaattattgagtgattatatcggtcaacctcaagttagagagcaaatggaaattttcatccaagcagcaaaattacgccaagatgcacttgatcatttgttaatttttggaccccctggactaggaaaaacaacgttggcgaatattgttgccaatgaaatgggagtgaatattcgtactacttcaggtccggttttagaaaaagcgggggatttagcggcaatgctaacgaaccttgaacctcatgatgtattattcattgatgaaattcatcgcttatcaccagctattgaggaagttctttatccggcgatggaagattatcaactggatattatgattggagaaggtcctgctgcccgttcaataaagctggatttaccgccttttacgctgattggagcaacaacaagagcaggctctttgacttctccattacgagatcgattcggtattgtgcagcgactggagttttattctgtagaggatttagcttccattgttactcgaagtgcggtctgtttgcagcttgaaattgatgttgaagcaggacaagaaattgcttgtcgttcacgaggtaccccacgtattgcaaatcgcctattacgccgagtgcgagattatgccgatgtcaaaaatggtgggaaaattaccgcacttattgctcaagaagcactgaagatgctggatgtggatcttgcaggatttgattttatggatcgtaaattattacaggcaattattgagcggtttgatggcggacctgtaggattggataatttggcggcggcaattggcgaagagcgagatactattgaagatgtactggagccttatttaattcagcaaggatttttacaacggacacctcgtggaagaatagcaacatcaagaacttatcgacattttggtttggaacagattgaaaaatagcactcctttttcagtcactctcaacgtgagtcagtcgatagtcaaggatttcaagcaacttataggcttgtgcgagtatccttctattctgtagtaaagattctgcaaaggtactatttattgctcaaaatcccatttgcacacacataggctgagctccatgcccattggaagttataaccgccaagccgaccggtaacatcaagtacttcaccaataaaataaagacctttgattttatgactttccatcgtttttgatgagatttcttgcgtatctacgcctccaatagtgacttctgcggtgcgataaccttcggtgccgttaggttgaatttgccaatgatgaattaaatcatcaagattttttaactgcactttgctgaggttggcaatcacttcatcttgaataatgttgtgatttaaccataaatccactagtttttgcggtaataggcgtgataaggcggtttttaaatgtaatttaggtgaggtctgacgtaacttgttaaggaaaaattgaatattttccatcggtaacagatcaatttctatattttcattcacttgccaataatttgaaatttgtaaaatagcgggacccgatatcccccgatgagtgaagagtaaattattgctgaaagattgaccgcactttgcggttacacaaacaggaagggagatgcctgaaagtgcggtgtaaaatttatcaatttcacgccatgtgaagggtacaagcccagctcgtggagcaataacattgagcccgaattgttcggcaacttggtaaccgaaaggtgtcgaactcaaggctggcatagacaatccgccggtagcaataactaaattttcacattgccaaatttttccgtcagattgcaattgaaaacgagctttttcattaccgtctaatttttcaatgtattcgatctgttgacgtaattgggtattaacttgaaatttatcgcattctgctcgtagcatattgacaatatcttcagcactgttatgacaaaaaagttgccccgattctttttcataatagctaataccatagtcagtaatgagggcaataaaatcccattgggtaaagcgagctagagcagacttgacgaaatgaggattttgcgaaaggtaatgctgaggggtaacattaaggttggtaaaattacaaaatccgccaccggacattaaaattttacgtcccactttttttccattatctaaaatcgttacttggtgcttggctttacctagttgaccagcacaaaacaagcctgccgcacctgcaccgataataattgtttgggaataattcatcattatttattcgctaaaattaccgctcttttgggagccgggtacccttcaatggttttactgtgatcttgaggattaaggaaatcaattaaactttcattttccagccagtctgttttacgttgttcttctagacctgttgtttctacatcgacacaacgaatatcatggaaaccgcacttttccagccagtttatgagtgcgagaacggaagggataaaatacacatttttcattttggcatagcgatctgtcggcactaaaatcgtgtttatatcaccctctacaactaacgtttcaagtactaattcgccatctttaactaattgatttttaagttgtgtgagatgatccaatggagattttcgatgatataaaacgcccatagaaaagacggtatcaaaggcggctaaaggttgcatttcttcaatgccgagcggaatcagattagcacgacgatcattgtttaacagtttacgtacagcctcaaattgacataaaaacagttctgtcggatcaataccgactaccattttggctccttcgccaaccatacgccacatatgataaccgctaccacaccctacatctaacacaagacgattctgcaaaggtgccaaatgaggcaagacacgctcccatttaaaatccgaacgccattcacaatcaatatggataccatatagatgataaggtcccttacgccaaggcataagctgttttaagtgatgaatgatgcgttgtcgctcaccggaggaaagaggcgtttttgtttcagctttgaccgcacttttgagatcaatatgatcggctgttaagtgcggtagaaaatcaatgatttttgaccatttaatataatcgccatgggtttgcttttcccattgtttaagttgtaaaggcaaagtttcaagccatgctgaaagtgtcgaagttgctatttgttgatagaatggacgaaagtcgaacataattattttgatgccttatatgcgtttttagcttgttcaaacgtctctaaaatcgatttttccggtttcactgataacaaagaaacaacaataatgacaatacttgccaaagcaaaacctgggatcatttcatataatttagagaattcacttgttgtagggacaatggttttccaactaaatacgataattgtcccagttaacattcccgccattgcagcagaagatgtcatgcgtttccagaataaagaaaatagtacaacaggcccaaaagcactgccaaatccagcccaagcaaattcaactaattttaaaacttggcttttttcatcttgtgcaatccaaattgcaatggcggcaatagctaataccattaagcgaccaagccacatcaattctttatccgatgcttttggacgaataaatcctttgtaaaaatcttctgtaacggcactggaagaaatgagaagttgtgcactcagcgtactcattactgcggctaaaatagcagaaagtaagataccggcgatccaaggattgaacaataattttgataattcaataaagatttgctccgattctttgttgacgacaccagctagttgtggatttgctgtaaaataggcgatgccaaaaaaaccgatacctatggcaccggctaaacaaaggatcatccaagtgatactaatacgtcgtgcgttattgagcgattttactgtgtgtgccgccataaagcgtgccagaatgtgcggttgtccgaaataacccaatccccaagaagccaagctcagtagaccaattgtggtagtaccggtaaaaatatctgtaaagttttttcctaccgcactttcagcctgcttcaagtagaaatgaaaattatctattccgtctaagcttagaataatcatgataggggttagaatgagtgcgaaaatcatcaatgttgcttgaatagtatctgtccaactcactgctaagaaacctcctatgaaggtataagcaatagttgccaatgcaccataccaaagtgcggtggaataagggatactgaacagattttggaataattttgcaccggcaacgacaccggaagcacaataaattgtgaagaaaacaaggataattgaggctgacacaattttgagtaaattatgacgactaccaaaacggttgtgaaaatattcaggtaatgtgagagcgttattattaaattcagtgtaaatacgtaagcggcctgccacaaataaccagttaaaataagcaccgattgttaaacctatggcaatccaaccttcaattaagcccgacaaatagattgtacccggtaaacccatcagcaaccaggcggacatatctgatgcaccggcagacattgcggtaacaaaactgcctaaacgacgaccgccaagaatgtagtctgaaagattattggtgtagtaatatgcaagtgcaccaatcaataacatgcctaagatatagacaataaaggtaataattgttggatcaaaactaaacattaagccctcacgaaagcattatttgtatagataaaatttaagaaaggtcgcattttaccttattcagggctattattctatttaccttttcgatagactaattaaaagaagtatttttaggatagagatgatggaatctgttgaattattggctaacattacccctagtgaaacccgaattgcactggtggataatggcattttaaaagaagtacatattgaaagacaggcaaaaagagggagcgtcggtaatatttataaaggacgagtgactcgagtattgccgggtatgcaatctgcatttgtagatatcggattggaaaaagccgcttttttacatgcctcagatattgtttcacatacagagtgtgttgatgttgatgagcaaaaacagtttgtagtgaaagatattgcacaattggtacatgaaggacaggatattgttgttcaggtggtaaaagatcccctcggtactaaaggtgcaagattaacaactgacataacactcccttctcgttatcttgtttttatgccggaaaatagccatgttggcgtttctcaacgcattgaaagcgaagaagagcgggcacgtttaaaggaacttgttttaccgttgtgcgatgaattgggcggttttattattcgtactgctgccgaaggagcaacggaaactgaactcgtgcaagatgcggaatttttaaaacgattatggcgtaaggtgttggaacgccgtgcgaaatatacaacacgttcaatgttatatggcgaattggcgttaacgcaacgtattttgcgagattttatcggggcgaatttcagtaaaattcatattgattccaaattatgtttttctgaagtgaaacagtttactgaggaatttatgcctgaactgacagataagttggtgttatattccggcagtcagccattatttgatgtttatagcgttgaaaatgctattcaaacagctttaaatagtcgtgtaaacttaaaatccggtggctatctaattattgaacaaaccgaatctatgacaacgatagacattaatactggtgcttttgtgggtcatcgcaatttagaagaaactatttttaatacaaatattgaggcaacaaaagctattgcacaacagttacaactacgcaatctgggcggtattattattattgattttattgatatgcaaacggaagaacatagggatcgtgtcttggaatctttacgtttggcattatccaaagatagagtgaaaacgaatgttaatgggtttactcaacttggtttagttgaaatgacacgtaagcgaacaagggaaagtttggagcatattttatgcgatgaatgtccaacttgcagtggacgaggcagtgtgaaaaccgttgaaacggtttgttatgaaatcatgcgtgaaattattcgtgttaatcatttatttgccagcgaaaaatttgtagtttatgcctcaagagcggtggcggattatttaattaatgaggaaagccatggtttattagcagagttggaagtcttcattggcaaacaaattcaaataaaaacagaagtgtattattcacaggaacaatttgatgttgttgtaatgtaacttccatttttaatatgttatattgacctcatattcattattcaaggtatcggtatggttaagaatattggaattttatatattgcgacagggcgttatcacgttctttgggaagatttctataaaagtgcggaaaagcattttctacccgagttacctaagaaatattttttattttctgattatgagggaagttttttaggagaggaaagtggaaatgttcacagaatatatcaaaaaaaattaggttggccttatgatacgttgatgcgttttgatatgtttttaaaagagaaagagcgatttaaagagttggattatctcttttttgttaatgcgaatatgatttttattaaagatatacatcaaaatgaagttcttgcatccgataaagagttaattatgattttacaaccttggtttatcggtttagatattgataaaactacttatgacagaaatccgttgtccacatcgtatattccttatggggagggtgaacattatgttatgggcagttttaacggcggtaaaacgtctgcttttttagagatgtgtcagcaattaaatgacaatatctatttagatttaaaaaaggacattattgcactatggcatgatgaaagtcatttaaatcattattgttggcgaaataaagaaaaaatatttattttgccggacagttatttgttggatgaagggcaacagtacttcccaagtaaaaagtctcattatattaatcccttatatttaaaaaatcatgatgttcggttagttatgagaaataagaatcattataggttcggggggggggaattacatgagagggattactgatgaacggatcgaatttaattggtcaatttttttgttgaatttaaatgtgtatcgtctctatttaaaagagagaattagggctgtatttaaagttctttgtaagaactaatattgttaaggtaggacaaaaaaacaagatgttaaacaaagtacaagaatctatacttgctccaaataatttagaaccggataatttaaaaaatacatttgatatgttgtctcatcgccagattgattatgcagatttgtattttcagctcagtcaagatgaaaattgggtattggaagacagtattatcaaagaaggcggttttcatattgaccgtggcgttggtgtgcgtgcggtaactggcgagaaaacaggatttgcttattccgatcagattgatttggtcagtttacagcaatgtgccaatgcagtaaaaggaattgctttgccaaatcaaggtaatattattaaaccgattggctttaacgctgtaaatgcgattactcgttatcctgcagtaaatccgttaaatagtttgaataaagagcaaaaaattgaattattacatttagtagaccgtaccgctcgtgcatatagcccttatgtgacaaaagttgtagcgaatttaaccgctctttatgaagaaattttagttgtggcaacagatggtacgttagcagctgatgttcgaccgttaattcgtttatctattttcgtgatggcggaaaaagcgggaaaaagagaacaaggaagtgcgggcgttggggcgagagtaggacttgattggttctttgagccttataagggcgaacaacgtgcgatttattttgcgaaagaagcagcacgtcaagcattggtgaatttagacgctattgaagcacctgccggcttgatgccggtagtgttgggcgccggttggccgggtgtattattacacgaagctgtggggcatggattagagggtgattttaaccgtaaaggaagctcattgtttacaggaaaaattggggaattagttacttctccattatgcactattgttgatgacggcactctaccgaatcgcagaggctcgttgacaatagatgatgagggcgtgccaagtcaatgtaatgtattgattaaagacggtgtcttgcagggttatatgcaagataaaatgaacgctcgcttaatgggtgtgaaaccgactggaaatgggcgtcgtgaatcttatgctcatttgcctatgccaagaatgactaatacttatatgttagcggggcaaagtaagtttgaagatttaattgcttcggtcgattatggcatttttgcaccgcactttggtggtgggcaagtggatatcgtctccggaaaatttactttttccatgtcggaagcctatttaattgaaaaaggcagaataaccaagcctattaaaggtgcaactatgatcggacaaggaattgaagtgatgcaacaagtatctatggtagccgataatatggaaatagaccatggcataggtgtttgtggtaaagatggacaaagtgttccggttggcgttggtcaaccggcttgtaagatagagcaaattaccgtgggcggaaccgcttaattaaactatggtgaatttgtgatttgttagataattaatttttatagagaatatagacagtgactgaaacgactcaatcaaatttgcaattggctcaagcatataacgaactaccttatacttctaaagtttttgctgcttgtcaacctactcgtttacatgctttagctaagattaaagggcttttaccccccccccttagaaacagctaaggtgctggaaatcggttgttcttttggcggcaatttattgccctttgctattcgacaccctaatagccagttagtcggtattgatttatctgaataccaaattaatatcggccagcaaatgatggaacaggtcggcgtgaaaaacgtagagttggttgctgctgacattagccaagtgagctttaatattaagtttgactatattatttgtcatggtgtttttagctgggtgccggaagcggtacgccatgcaattttaaaaaccatccaagagtatttatctcccaacggtatcgctcatattagctataatacctacccaggctggaaaattcgagatgtcgctaaagagctgatgtgttttggaagcaatccgaatttaagcagtttggagcgtatagaccaatcttttgagttattaaaatttacctcttccattttgcaacgaaagaatgctgacttatataaagtattatcgcattcatttcaagaaatacctgataaagataaattttacgtggctcatgaatactttgaggattttaaccaacctttctatttcagggaatttatcagccaacttgaggcataccatttagcctatttaaccgatagttcttttcccgctatttattcagatgtgcattttgaacatgatgaatatgagaaagtgtgtgcctattttgattaccgcttggaagccgtagaacaatttattgatttcctgaataaccgctcttttagacacagcattattacccatcaacaaaatttggcggacaaagggattaccaataatatcagtcaatacaatcattgccatcatttctatgatatctatttcagaacagatgtgcgttatagccctgcgactgatgataaggaagcgcattggcagttgctggacataggtgcggaaatttcggatactccattaaataatttattatgtacttatcttcaagagcataacaatccttgtaaaattggcgatatttgtgagtatgccaaaaaattccccgaatatgacgaaactgaactttacaaattaattctttctattatttattctaatcatgtttatttatgttttgagccagaaacatcgaccggctatgacagcaaacccaaattgtttgagccgtaccgaagattgattgatttggtcagacataatcccaatgttaccggattgtccaatcgatactatcaggtactcaacttagatttcttgccgcaatatatcgcacaatttctcgatggcactagaacagtcaaggatttaatcaaacaattgcgagaggacattgaaaacaataccattgtccttcatgatgaaaacggcaatgaactttcgaataaaaagattaaagataaagacctcaaagaagtgattgttcggcaattggacgcactcaaggagtacggttatttcacggaatataaatagtactgtgtaaattgtccaatcgtgagatagtgtagggagcgtatttaatattgcattgaatacgctctatttgtttaaatttaaactttaaaatcaggtgctaaacaaggttggattttattgagtatttcttttacaagacgtggtgttgctgcaacgatatgactgtcagtgaaatatttatgaccaccgtagaaatcacatactaaaccaccagcttcacgtagaatcagatcacctgccgtaatatcccaaggtttaacgcccatttcaaaataaccgtcaacacgattagctgctacatagcaaagatcaagtgcggcagaacctgcacgacgaaaatcagcaacattttcagcaaggttgctcatcatagcaaattgggttggcatgagagagggttttttgaatggaaatccggttgccaaaattgcaccttgaaggtcacgtttactgctatcaacacgtaaacgtaattcattaattttcgcaccttcaccacgcacagcggtgaataattcattgcgaataggatcataaaccacgcctatttcagtgcgaccttttacacggacagcgatagatacagcaaagtgcggtaagcctttgacaaagtttgtcgtaccatctagtggatctattacccattgaatatcgttgttttgtccttcgtgagcaccgctttcctcagtaataattgtatgctcgggataagatttgcgaacaacctcgataattgctgcttctgaggctttatcaatattcgtaacaaaatcatttatacccttttgcattgtttgaatttcatcgcggcgttcataacctttaacaattatattacccgcttttcgtgccgcacgaatagcgatatttaacattggattcatctctttccaccagatttcaaagaacacatggggtgggattatagtgaattttgcctataaaagcgagtagattttaggtttcctaacggttttttagggatcaaataacttttcgtaaattataggggctatgctaaaatacccacaattttaagtaaggtaaaagtcttaatgttggaaaatatcaaaattgttttagttgaaacttctcacagtggcaacattggttctgctgctcgtgcaatgaaaacaatgggactaaatcaattatgtttagttgcacccaaacagggaattgatgaacaggctgttgcgttagctgcgggtgctgaagatgtggtaaaaagtgcggtagtggcggacagtttttctcaagctgtagcggactgttctcttattattggcacaagtgcaaggttaagacatttacaaagtaccttaattgaaccgagagaatgtgctgaaaaagtcatacaaagtttgtcatctcaaaaagtagccattgtttttgggcgtgaacgagttggactgacaaatgatgaattattaaaatgccattatcatttaactattccggctaatcctgaatattcttcattaaatctggctatggcagtgcaattaatcagctatgaacttagactagcttggcttgcctcgttaaaagaactgaaacaaccgttttctgtgatagcaaataactatccgacatttcaagaattagagcatttttttgcacataccgaacaactctatcaacaacttggttttattcaaaatcaaggggttatgaaaaaattaagacgtttatatcagcgtgttcaacttgaaaaaaatgagttgaatattttgcgtggtatgttaagtgcggtagaaaagcgaattaattgcaaaaaattagaagttgactaatttagtaggattagtaatatatccgctcaatgtggatctaaaggatattgagaatgaaattaacatcaaaagggcggtatgcggtaacagctattttggatattgcgttaaatgctgagcttggacctgttagtttagcggatatctctgaacgacagcatatttccctttcttatttagaacagctttttgctaaattacgccgtggtggtttagtgaaaagtgtgcgtggtcctggtggcgggtatcagttaggattatctactgatcagatctccattggcatggtaattaacgcagttaatgaaaatattaacgttacaaaatgtttggggaatggcgattgtcaggggggagtaaaatgcttaactcattctttgtgggaagaattgagtgtacgaattgaaaatttcttaaatgaaataacgattgcagaattagttgcaaaacaagccaagtgaaatgagcagtacacgtttgagatagtgataaaaccggctaaaagtgcggtacaagaaaagattttttaggagagagtaatgaaattacctatttatttagattatgcggcaacttgccctgtggatgaacgtgtagtgaagaaaatgatggagtttttaagcattgatggaaattttggaaacccggcatctcgctcacataaatttggttggcaggctgaagaagcggttgatgttgctcgcaatcatattgctgatttaatcggtgcggacagtcgtgagattgtttttacttctggtgcaacagaagcggacaaccttgcattgaaaggagtgatgcgtttctatcaaactaaagggaaacatcttattacctgtaaaactgaacataaagcgatcttagacacttgtcgccagcttgaacgtgaagggtttgaagtgacttatttagatcccaaatcagatggtttgatagatttagaggaattaaaatccgttattcgtgatgacacggttttggtttctataatgcacgccaataatgagattggtgtagtacaggatattgctaaaattggtgaaatttgccgtgaacgtaaggtattatttcacaccgatgcaactcaatccgtcggtaaattgcccattaatttgagtgaattaaaagtagatttactttctatgtccagtcataaattatatggacctaaaggtataggtgctttatatgtttgccgtaaaccacgagttcgtttggaggcaattattcatggtggcggtcatgagcgtggtatgcgttcaggaaccttacctgtacatcagattgtgggcatgggtgaagcatatcgtattgctaaagaagaaatggcaacagaaatgccacgcttaaccgctttgcgtgatcgtttatataacggcttaaaagatattgaagaaacctatgtaaacggttcaatggaacaacgtttaggtaataatttaaatattagttttaattacgttgaaggtgaaagtttaatgatggcgttacgagatattgcggtatcttccggttctgcctgtacatcggcaagtctcgagccttcttatgttttgcgtgccttagggttaaatgacgaattggcacatagctcaattcgttttactgtggggcgttatactacggaagaagaaattgattattctatcggtttagttaaaagtgcggtgaaaaagttacgtgatttatctccactttgggatatgttcaaagagggtattgatttaaacagtattgaatggactcaccattaatagaagagtttagcagtttgttgggtaggtttatcgcttacccattttaagaaatgagaaaaaataggaacgaaaaatggcatatagcgaaaaattacttgatcattatgaaaatcctcgtaatgtaggttcgtttgataaaaaagatccgacagtcggtagcggtatggttggtgcacctgcttgtggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattacaaagcgaaaaaagctgaatagttaaagaagattaaaggagtaatgaggtgcatataattttaatattaagccacattattccttttgtgtttagttccctttagttggatttatgtttagataggtagttaaatttctagcagttataatgagttgagaattaactatattgattaaggagaataaatgagtatcaccttaacacaagcagcagcaaaccgagttcgtacttttttagaaaaaagaggaaaaggaataggtttacgtttagggattaaaacgtcaggttgctcaggcttagcttatgttttagagttcgttgatgttttaaatgaagatgatgaggttttcgagcaagatggcgttaaggtgattgtggatcataagagcttagtctatttagacgggactcaactggattttgtcaaagagggactaaatgaaggctttaaatttagtaatccgaatgtaaaagatgaatgtggttgtggtgaaagtttcaacgtataggcaggcatatatatgataaatccatttgcgttatttgatttggaaattgattttaatcttgatcaacaaatactctcacagcgttatttaacgctacaaaaatctttgcatcctgataattttgctcatagatctgcccaagaacaacgtttagcactgcaaaaatctgctgaaattaatgatgctttacaaatactgaaagatcctatcagtcgtgctgatagtataatcaatttgcatcttggtgaacaaaatatagagcaaaaaactaatcaagatatgatgtttttgatgcagcaaatggaatggcgagaacggttggagcaagttgagcaacaacaaaatatggataagttattacacttctcgcaagaggtcgagtgtgtacaacatgatattttagcggagctacaagaatttctagcacaacaaaattggcaacaagctcaattgctaaatgatcgtttacgttttattaaaaaattatttgttgaaattgaacgggttgaagaacagttagctggtttttagctcagtaatttatttagaaagttatgacgagataatagagtatggcattacttcaaattgcggagccagggcaaagtgcggcaccgcaccaacataaattagctgtaggtattgatttggggacaacaaactctttggttgcagctgtgcgtagtggaagtagtgaagttttgcgggacgaacaggatcgcttgcttattccatcgatagttcatttaacagaagatcaagcgattgtggggtatgaggcaggtcaacttgccagtcaagatccgcaaaataccattatttccgtgaagcgtttaattggacgtagttgtactgatgtacagcaacgttatcctaatttgccttatcaatttagtgcaactgaaaatggcttacctctattaaagacaagaaggggattattaagtccggtagaaatttcagccgaaattttgaaaaaattgaccgcacttgctgagcaacgtttgggtggagaattaactggtgcagtgattactgttcctgcttattttgatgatgctcaacgacaaagtaccaaagatgctgcaaagttagctggtttaaaggtattgcgtttacttaatgagccgaccgctgctgccatcgcttatggtttggatagtggacaagaaggtgtgattgctgtttatgatttaggcggcggtacttttgatgtgtccattttacgcttatccaaaggtgtgtttgaagtgcttgctaccggaggtgataccgcacttggtggtgatgattttgatcatttattagcggagtggattgtaaaaaaatcaacagtcgcacctcaaaatgatcgtgaaaaacgtcaacttattgagcttgcaaaccaaattaaagttgctttgacctcgagcgataaaatccggatttcttatgcagagcaaaatctggaaattacgcgtgatgaatttaattctctgatttcaggtttagtcaaacgttcattattagcttgtcgtcggacgttaaaggatgccaatttaactccatcaaatatattggaagtagtgatggtgggcggttcaacgcgtattccttatgttagagaacaagttggtgagtttttccaatgtacaccgctgacttctattgaccctgataaagtggtggcattaggtgcagctattcaggcggatattttagtaggaaataagcctgatagtgaaatgttattgctcgatgtgattccattgtcattaggtattgaaactatgggaggcttggttgagaagattattcctcgtaatactactattccggtagcaagagcacaggaatttactacattcaaagatgggcaaacagctatgtcggtgcatgtgttacaaggtgaacgtgaaatggttactgattgtcgctctttggctcgttttactttacgaggtattccggctatggtggcaggtgcagcacgtattcgagtcacttatcaagttgatgctgatgggttattaagtgttactgcagtggaaaaatcaacaggagtacaagcatcaactcaagtaaaaccttcctatggtttaactgatgatgaaattgctaatatgctaaaatcctcaatggagcatgctaaagaagatattcaaactcgtttactaacagaacagcgtgttgatgctaccagagtcattgaaagtgtttattcggcattacagcaagatgaagatcttttagatgataatgaattaagtgcggttaaaaatgccttagtttcattacaaaaattgattcaagaagaagatagccttgctattaagcaagggataaaaatgcttgatcaagcaacgcaagaatttgcctctcgccgtatggataaatctattcgtcgagcattaagcgggcaacatattgaacatattaaataaaggaaagtagaatgcccaaaattgtttttttacctcatcaagatttttgtcccgaaggaatggttgttgatgctgcaccgggagaaaatctattagacgttgcacataatgcaggcgtggaaattcatcatgcctgtgatggctcttgtgcttgtaccacttgccatgttgttattcgagagggatttgacagtttaaatgagacaacagaacaagaagaagatatgttagataaggcttggggcttagaaatggatagccgtctttcttgtcaatgtgtggtcggagaggaagatcttgtagtagaaattccacgttataatttgaatcatgctaatgaagcggctcattgatccatttatatcaaggtgcatttagcaccttaattattatgctcaaattatataagttatatccaattattctctgctttttgagcgaaaattcagtaatatacaggctttattctcaagtaaaggggatataaatgaaaatccaacatttaattaagcaacatcaacttggcttattgtttcaacaaggctcctttggtttagaaaaagaaagccaacgagtttatcaagacggttcggtagtaacaaccgaacaccctaaatgttttggtaacagatcttaccatccctacattcaaactgattttgcggaaagtcagctcgaattgatcacgcctcccaataaaaatttagaagatagtttaagatggttatccgctattcatgaagttgttttgcgttctttgcctgaggatgaatttatttttccgttgagtatgccggcaggattgccttcagatgaattgataaaagtcgctcaattggataaccctgaagatgtggcatatcgtgaacatttagttcagtcttatggcaaaaataaacaaatggtcagtggaatccattataactttcagttggatccagcacttattcaaaccttatttaatttacaacaagaacaaaaaagtgcggtagattttcagaataatttatacttgaaaatggcgaaaaattttcttcgttatcaatgggttctattgtacttattatcagcgacaccaacagtagagagtaattattttaaaggtagttcgccattaggaaaaggtgaatatgttcgcagtttacgttcaagcaaatatggttatgtgaatgatcctgaggtcattgtttcttttgatagtttagaacaatatgcagaaagtctggagcattgggttaaaagcggaaaactgatagcagagaaagaattttattccaatgtgcgtttacgaggtgcgaaaaaggcgagagatttaattcaaaatgggattaaatatttagaatttcgcttgtttgatctcaatcctttcgagcaatacggtattagccttgcggatgcaagatttattcatcattttgtactattgatgatttggcttgatgaaatgccagatcaacaaggtgttgaactggggcgtagccgtctagcggaagtagctctagaaaatccgttggcacaaactgcctatcgagaagaaggtgagtggttacttaatcagttaatcagtatgttgcaaagtatcggggcagaccaaagtgcggtgagttttgtccgagaaaaattagctcaatttgctgatcccggtctgactttatgtgctaggttagtccaagaaattgaacaaaagggcggttatcaaaaattaggtgcagagcttgccaaacaatataaagcaaatgcttttgagcgtttttatgcgttaaccgcttttgataacatggaactttcaactcaagccttaatgtttgatttaattcagcaaggtatcagttttgagatcttggacgaacgagatcaatttttacgcttacagtttggtgaacatgttgaatatgtaaaaaatggtaatatgacttcacgagacagctatatttctcctctcattatggaaaataaagtggtcacgaaaaaagtattggacaaagcgggatttaatgtgccacagagtcaggagtttacttcagttaaacaagcgatagccggttatagcctgtttgaaaaaagagcggtcgttattaaacctaaatctactaactatggcttggggattacaatttttcagcaaggtgtgaataatagagaagattttgccaaggcagtggaaattgcgttccgtgaagataaagaaattatggtggaggattatttagttggtactgaataccgcttctttgtgttaggtgaggaaacgctggcagttttattacgtgttccggcaaatatagtaggcgatggcattcatactgtggctgaattggtagctcaaaaaaatacgcatccattgcgtggtgatggtagtcgtacgccattgaaaaaaattgcattaggcgatattgagcaattgcagttgaaagagcaaggtttgactgttgagagtattccagctaaagatcaaattgttcagttgcgggcaaattctaatattagtacaggcggtgacagcattgatataactgatgaaatgcatttgagttataaacaactggcggtggggattgcaaaagctatgggggctgctgtgtgcggtgtggatctgattatttccgatttgaaagaaccggcacagcctgatttaagttcttggggcgtaattgaagcgaattttaatccaatgatgatgatgcacatcttcccttatgccggacaatctagaagattaacaagaaatgtgattaacatgttgtttccggaagtaaagtaaataatgtttttcgtaaaataggcggtttttagactgttaatgataagggctggtagtttaccgagaaatttgatttgctagtgtaatggaaaaaatggttgctaataatatatttttgacgttattagcaacgattttgtctattatgctactgcttatggtaagcaattatagcgaatcccccaacaaaacagattctaatgcaatttcgatcatttcattgaaagttaattgtcgctcttctgcactggtttgttcatgcgtacggatatgatcagaaacagtacagattgttaaggctttggctttaaattcagctgctacaccataaatgccggcagcctccatttccacacctaaaatgccatatttttccatgacatcaaacatttctgggtctggcgtataaaataagtcggcggaaaacaagttacctacttttacatcaattcctttattttttgcagcctgtacggctgcttgtgccatgccaaaatccgcaatggcagcgaaatcgttatctttgaagcgaatacgatttacttttgagtcggtacaagcaccaagaccaataatgacatcacgaattttgacatccatgttgaccgcaccacaagaaccgacacgaataattttttttacgccatattctgtgatcaattctttagcataaatggagcaagatggaattcccattccatgtcccatcactgatatttttcgtcctttgtaagtacctgtgtaaccaagcatattacggacatttgttacttcttgtgcattttctaaaaatgtttctgcgatatattttgcacgcaacggatctcccggcattaaaacaacatcggcaaatgcaccggatggtgcgttaatatgtggtgtcataaatgtttccttttgttgattaaaatattatttttccttaaagcaataaagcaatcgttttcttttacctaaaatgaacacaccacgaaaggtcatggtgtgaaatatggatgacggaattaaaccgcacttttacagtgcagcaccgcttaatccaataaatagacctgcaattgttgcactcattaagtttgctaatgaaccggcaattaccgctttaatacctaagcgagcaatatcaccacgacgatttggtgccattgcccctaagccaccgattaaaattgcaatagagctaaagtttgcaaatccacagagggcaaaagtaataattgctttagttttatcacttaattgcaccgttgcatcagctgcaaggtatggtacaaaatctaaataaccaacaaattcattaattgctaatttggttccaatcatacgaccggcaatttccgcttcttcccaaggaaccccaataatgaaggctaacggcttgaaaacccaaccaaagatcatgccaagagaaagtccttcttgaccaatccagtttccgatagtgccaagaattccgttaagtaatgcaattaaagccacaaatgcgatcaacatcgcacccacatttaaggcaagttgcataccagatgatgcacctccggcggcagcatcaagaatatttgttggtttttcttgttgtatttgttcgaaattatcattaaatttttcagtttgtgggataagaattttagcaaataacaatccggctggagcagccataaatgaagctgcgattagataggttagaggtacacccattccggcatatccagccatgactgaaccagcgatagaggctaaaccaccgcacattactgcaaacagctctgattctgtcattttgctaatataaggtttaatgactaagggggcttctgtttgtcccacgaagatattggctgctgccgacatagactcggattttgatgtgcctaatgctttttgtaatgctccaccgatgattttaatcagccattgcattacaccgatatagtaaagtagggagattaatgcggagaagaaaacaatatttggaaggacgttgataacgaaaacaaaaccggctgatcccatagaaccatcggcttgtggtgctaacccattaaatagaaaacggatcccttcattaccataattgatgaccgattgtactgctcctgcaacgctttgtagtacctgacgaccaacgggaacataaagaataaatgcaccaaataaaaattgaattaatagtgcacctagcactgtacgataattaatcgccttacgattattagataaaagaaaggctattaataataaagcgaagataccgataatgctaatcagagaactcataatgtgaatatccttataggtgtgttaaaaatgcacgtattctactcggttttatataaaaaatcttgtactttctaagtgagttatagcttttttaaatttataaatattctttgttttggattaaatttaatttcgattatgattaacacaacgcaactgttgggtcgtaataatgaaaaaatttaatgagcttcctcaaactccttgggcagccaaatctttgtgggaaatagaaacaaaatcgctattggtattatgtttttcactttccttgctcggtattggtgatggattgttggttttatctaatttaggctctgcaccttggacagttttgtctcaaggcattgctttacaagcacaatttagtgttggctgggcatcatttatagtaagtatcttagtaatgttaatgtggattccgttaagattaaaagttggttttggaacaattctgaatgttgttctgatcgcattatttcttggtttaagtacattttatatttctccgccgagttcccttttagcaaggttttgctatcttataatgggtattattttttttggtatcggaaccgcattttatttgacttgccatcaaggggcaggacctcgagatggattaatggttgggttatgtcatcgctttaaattaagaataggaatagtccgtactcttatggaagtttctgtttgttttttgggttttttgctaggcggaacagtaggaattggtacactattatttgctaccagtattggttggattattcaattaggggtttattttattatgaaacttaacaagtcggtctaagaaatatggcattattgccagtcttaattttaaagcatataatctttgccattttattctatatctaaataaacctatgatgagattaccaatcagcgtcacaatgcttgtgaaaaatgccgagaaatatttggcaaaaagccttagttctttgaaagatttccctgaaattattgtgttagataatggatcaacagatcgatctattgaaattgcaaaacaatttactaatgtcaaaatttatcattcacctttcattggttttggaccgatgaaaaatttagttgcaacttatgcaagttatgattggattctaaatattgatagcgacgaaattttacaaccccagcttattcaagagatttctcagcttaatttcgatgaaccccgcaaagtttacgcattgttaagaattaatcattaccgtggaaagccaataaaaacttgtggttggtatcccgactttgtgaaacgtttatataataaaaagttggtaaaatttgatgacaagcgagtgcatgaggcattagagattgcagatgatatacaggtagttcgcttaaagcatgaatttaatcattattcttttgatagtagtgagatgttgattaataaaatgcaacattacaccgctctttttgcggaacaacaaaaatatagaaagaaaagtagtgtattgtcagcaattgctcatggaatagttgcatttttcaaaagttatatattaaagagagggattttatcaggaggcgatggttttattatttcttttgccaacgccagcggttcttactataaatatattaaattaatggaagctaatcagagtttaacaactgctttaattataacaacttataatcgcccagatgccttagaggctgtgttagtatccgtattagcacagagccttttgccgaatgaagtaattatcgctgatgacggctcaacagaagataccaaagaacttattcaaaaatatcaagcaatttttcctattccacttaaacatgtttggcaaccggatacgggctttcgtttagctgaatctagaaacaaagcattatctttagttgagtcagaatatgtaataaccattgatggcgatatggttttacatcctcaatttatttctgatcaccgtaaagcggcagaaaaaaatgtatttgtggggggggggagaatattgctcactaaggataaaacgaccgcacttttacaatcatcagaacaatattcctcttttaaatggtatgaaaaagggcttgaaactcgttttgaaaaacgtttaatggcgttgcatattcctttcttgtctgaatttatccaaagaaataaaaaagtgcattattataacgggataagagggtgtaatatggcattttttttatctgatgctttagaaattaatggttttaataatgattttgttggttgggggcgtgaggatagtgaatttgtcgctcgtttttttaataatggaggaaaaagaaaaaacatcaagtttgcagcgattgcatatcacttgtggcatcctgaagaagatagagaagccttgccagttaatgatgaattacttaaacgagcaattgaagataaattggttttttgttcaaatggattgaaccaaattaaattggattaaatattattctttatatttttgtaacgcacttttcagcagggagatgtaaatagacttgctttttagctaaaaaagagtacaatcttcaggctttttgtctatatatacagagaaaaaagtaagcattcccactcttttgatgtgggttttcttttagtttaaattagttagaggaaggttatggtaaccattcgtttatctcgtggcggttctaaaaaacgcccgttttatcaaatcgtagtagctgacagtcgttcacctcgtgatggtcgtttcattgaacgtgttggttttttcaatccgttagcatcaggtaatgttgaacgtgttcgaatcaatttagatcgtgtgaatcattggattggtcatggtgcatctttatctgatcgtgttgctagcttagttaaagaggctcaaaaggcagcttaattttagcgattttataggtgaatgaaatggaacaacaaagaatagaagtcgttggaaagttaggttcaacatacggaattcgtggttggttgcgtctttattcatcaacagaacaagctgaaagtatctttgattaccaaccttggtttttaaaaatcaaggggcaatggcaaccaattgaattggaaagctggaaatttcataatcacgagttaattgttaaattaaaaggcattaatgagcgtgaggtcgcacaaactctggcaaatgttgaaatcggagtaaatttatccgtttttcctctattagatgagggggatttttattggcatgatttaatcggttgtcaagttgtgaatctacaaggttatgcaatgggtgttgtgtctgaaatgatggaaaccggtgccaatgatgtgttggttgtgcgtgcaagtacaaaagatgcttttggtaaaaaagagcggttgattccgttcttatatgaacaagtagttaaaagagtggatctcagttctaaaactattgaagttgactgggatgctggtttctaacctcaggtaatctgtaacgctttggcagtaacataaacacagaaggtaagtaaatgtggatcgggattattagtctatttcctgaaatgttcaaagctattacggaatacggagtaacaggacgagcagttaggcaaaacctgctggagatacaatattggaatccgagagatttcacctttgataaacataaaacggtagatgatcgcccttatggtggaggaccgggaatgttaatgatggtgcaacctttgcgtgatgccattcattgtgcaaagtctgtggcaggtgatggtgtgaaagtgatttatctttcgcctcaaggacgtaaactggatcaaaatggtgttcaagagcttgccagaaatcaaaaaatgatttttgtttgcgggcgttatgaaggcattgatgaacgattgattgaaactgaaattgatgaagaatggtcaatcggagattatgttcttaccggtggggaattgccggcgatgacgttgattgatgcagtcgcaagatttgttccctgtgttttgggtaaacaagcctctgcacaagaagattcttttgcagaagggctattagattgcccacattacacaagaccggaacaattaaacggtttaactgtacctcctgtattgatgtctggtaatcatgaggaaattcgtaagtggagattaaagcagtctttgcaacgaacatggttaagacgacctgagctattggaaagcctagctctgactgacgaacaaagtaagctgttatcgcagattaaacaagaaaacagttaatcagttaaatctaggatctaagaaggattactacaatgagtaatatcattaaacaaattgaacaagaacaattaaaacaaaacgtacctagcttccgtccaggggatactttagaagttaaagtatgggtagtggaaggaagtaaacgtcgtttacaagcattcgaaggtgtggttattgcaattcgtcaccgtgggttacatagtgctttcactttacgtaaaatatctaacggcgtaggtgttgagcgtgtattccaaacacattcaccaattatcgacagtattactgttaaacgtaaaggtgcggtacgtaaagccaaactttactatttacgtgagcgttcaggtaagtctgctcgtattaaagagcgtcttggtaattagtttattagacttatataaacaaccccttggatactccaaggggtttatttatagaaagattggcacgttttgaccttaaatcataaaatccaaccattaatagaacattaagtaatatgatgaatgagcacatattacaataatgcaaaatgcaaaaattccacaaaatgatctgcccagtgtttttcatggtgaatttcatttgccatcattcgtaagcgaatgttatctaatggatgacctgtgcgtaataaggcttggtaataatggagtgtgcaatcaatataggcttggttcatatttgaaataaataatgaatcaacatcatctccttctttagtgcctacttgaataaagactttactatttttatcaattggattgtggtggataaaatgcagaaaatctttttcactaaaccaagacgcgagagaaaaaacacctaaatgtccaaaaatttgtggatatgctgaccccatataggcagtgataattcctcccatggaactaccggcaagcaaagtatgttctttttgtggtttagtgcggtaatgttgatcaatgaatggtttaacgatctcaactacccatttgccgtattccatacctttcccaccgcattttttaatttccggtgacgagcctacgtcagtacgccaaggtccatattcatcaagacgatctacacctgaattatctatgccaacaataataattttaggaaattctttatggtgtttaatggttggaataattttccaagagtaacctgagtaagattctttactataaaaaatattttgtccgtcatgcatatagagtactgcataactatcccacgtatcggtgtaataatcttttggcaataacactcgaatacgacgagtgcggttatagtagggaacataaagaaaatgttcttccatttttaaataataattagtatttttcacaacaaaaaccttataaacgtaaaacaaagtgattttttaaatactttcacctaaatgaatattatatccgagattgatcatgtaattttcaggtgcaataccttctatacgattaagtaattcttttgccgctacttcaccgatatttaagcgtggtgtgcgtacagtggcaatttgtgtcgttaaagataatccaacatttaacccatggaagcctgcaataccgatttctttaggtacgtcaattccttgacgttgacattcaaataacgcaccaattgctaaatcatcattggtacaaaaaatgccatcaatttggggatgtttttttaatgccagttttaattgttccgcacctaaagtaaatgatgatggttcttccgtgaggagactgtgaggtgtcagttgatgttttttcattgcttgttcgtaaccctgcatttttaaacgggtacgtttatccatacgagcagagaaatagacaatatttttatagcctcgtttaatcattgtttccaccatagactgtgctgccgctatattgttgaaccccaccacttgttgtaaaccgaattcgctggtatccataatttcgacaacgggaatatttgccacatctaacatttttagcgttcttgccgaatgttctgtttccgacaaaataagtccatcaatgttataagagagaagcgattcaattcgtttttcttctttttcttgacaataaccataatgggctaacatggtttgataacctgcttgatcggtaatattctcaatacctttaattacatcggcaaaaacatgatttgttaaagagggtacaagtacaccaatcgctttgcttttcgcattggataaaatttccggtgcacgattaggaatatatccgaagtgttctatagcttcggcaatacgcacacctgtttttggtgcgacaagacgtggatcacgcaaataacgacttatcgtcattttagtaataccaagatgagaggcaatatcttgcaaagtggggcgtttacgtttatcgggcattttttatcctaacataactttatttctgtccattttgccagcaatatgcctgttgcaacagaaacattcaagccgtgttttaatggattaactaatgacaaattaatcagttcatctgctttatccgctaatgattcagtatcagcttcactcagtacaaatgcaactttatcattgagttgtaattgcttaatggttttggcgtgtttatttgagcttagatgaacgatttgatagcctgcttgtcgcaatttaaccaatgccgtttcagtgcgatcaatttccagcggatgaatatattccataccgccttctgccactcgcattgctactgcagaatgaagaagttcaacatcgtcaataacaaccgcacttataccataacatacacaagtgcggataattccgccaatattatgtgcattacgcacaccatttaaaaccaataggcagtttttttggtgtggaatatctaaatagccgtgcaaagtaaatggacggcgttttttgaccaacatgcaaataccaccatgatgttcagtgccgctgactaaggctaactcgctattatctactacatgatagacttttttattgctggctaaatagctaaacaaatcccccactttatgtgccatttctaccgtagtccaaacacgcacaatactttccggacgttgtgcaaaaagggataaacaagcattttcaccatatactttcatttcctctgcacgatttttcttgatcttctccggtgcacgtggcgataaagggtcagttttcttttcagtttttgcaactaaacttgaacgttttagcacaacttgtacttgtcctgtaccgtttggcttttccatagtggtattgataatatgagtgtgggaagccgtattttgtgtatttttagggcgagagtgccgattggataaagctcgctttgagttattgtcaacgtgcggtgattttgatgtagatttttcatatcttttgttgctgacaaagcgttcagcaaagcgtttttcattatttgcttgttgaaaaattggtttttttgtcttcatgttggatattaatttaaggttagaaaaagataaagtgagcaaaaaaacaccgcactttatagagttttgtgaacattataacgaaaaaataccttttttctaccaagttaccgactaaatattgtaaactagccagccaaacacaaactcgtagagaagtgaattatgttgatcaataaaacaaaacgggcgaaacaaaatttggagcggttaccttgtattcctttgcaagcagagcaagttgagtttatttatcattcttcagattttaaacaacagattattcagtgtattcgtcaagcaaaatcaagaatttatttcaccgcactttactggcaaaacgacgaggcgggacagcaaatcctagatgagatttatcgtgctaaacaggcaaatcctgaattagaggtaaaaattttggttgattggcatcgtgcacaacgtaatttacttggtgctgagaaaagtgccacgaatgcggattggtattgtgatgaacgcagtaaatatcagttggcggacgatcctaatatattttttggtgtgccaatcaatactagagaagtattcggtgtattgcatattaaggggtttgtgtttgatgatacggttttatatagcggtgcgagcattaataatgtgtatctacaccaacaaacaaaatatcgttatgatcgttatcataaaattgaacataagagattggctgatatcttagtcagctttgttaagaattatttattcgatcctaatgtggtttatccgcttgattccggtgatcgtcctaaaaccaaagaaattcgtcagtatattcgtaattttcgtaaatatcttgccagtgagggacagtattatgtggaatcttccgtgaccttaaatgacagtttgacgatttgtccattatttgggttaggtgcaaatcataatttacttaatcaaaccattgaagatttatttcaagttgttgaggataagttaacaatttgtacgccttattttaattttcctcgtttattacagcaaaaagtacgccgtttgctggctaaaggaaagcaaatagaaattattgtaggtgataaaacggctagtgatttttatattcctccatcagagccttttaaaatggcgggagcattgccatatctttatgagaaaaatttgcgtcattttagtaaaaaatttaccaagcaaattgaacaagggcagttagttgtccggatttggaaagatggtgaaaacagctaccatctaaaaggcatttgggttgatgattgttatatgttgttgacaggaaataatttaaatcctcgtgcttggcgtttagatgcggaaaatggcttatttatccatgatccgaaacaacaattacaagcacaaattcaacaagagttgacctatattcgccgaaataccactgttttaaaacattatactgagttaagtgatctgactcagtatccgaagccggtacaaaaaatattgaaaaaatttgcccgcattaaagcagataagttagtgaagatgattttgtaagggttattcaaagcacttcatttcaaatattaaccgatagatcggcgataaatttcgccgatttcttttgaactcttaccaaacaccttttctaattgtgccaaaaaaagctcaccggcagatattgcatcaataagtgcattatgaccgatatattcgggcaaattatatttattacgaatatggctaagttgataattattttcgttgtcctgacataacgaacgttcaatttttaaggtatctaaccaaaacagaggaaattgcgataaattatagcgaacgttcagataatgtaagataaaacgcttttctatagtggagccgtgagcaataagaatacgtccttgcatcagctcaaagagtttattcattgtatcatctagggtttctgccccatttagcatttgtggcaaaatatgattgataataacagtatcttctttaatttcttgttgctcggcgacgaattgatgccatgcttttgaaatatctaatgttaaattgtcaatgggaacggtagcgacactcaaaatattatccatcattgaattcagccctgtggtttcgaaatcaattactaagtaggaaagtgcggtcaaatctgtggaacttttagggtaaggcttttcaaataaccttttccattgcacgggtaaattatcttgattaataaagatttttcgctgtttttccaatttattcaacggatgaaatttgttgaggaaattttttatcatctcattattcctcgttgtgaaaaacgtatctctgccgcctcttgaaattgggcaattaagcgaaaagcatctttaagatgatttcgttcaagggcacttaactcactgggatcgatatgattagttagttcttgctgttgttgcaatgcgtctgattgatatttaaaacgcatattgcagacaaattgatatacctccagtgcattattaagggtttctttattcagaataccttgcttgtaacaatgtctaaaacgctgttcagttgacatagtttgtgctaaaccggcagcaagtgcgtaaattcgtgcaagatctactaataaactgatagcacgttttttcaagttaagtttatttttatgttcaccttctttaataagaacaaaatttcggaaaatacttaatgggggttttactcgaatactgtttgccactaagaacgctaaaaagcgtttattgtgtgcgactaaatcgacaaaatattgctgaagttgatctgccaaattaagatcaccgtaaatacctcgcatatccataaatacagaagcattgagtaaaccttctaattcaggtgcaataatccaactacggaaattttctttccattcctgtagagaaacacaccagcgtgcatttattgccatatagttacccgtgcagtaaggatagccgcattcatgcaatccattgtttacaaatttagttagttgtacaaaatattcctgttcaagtgcggttaattttctttctaaaatgattgcattatcctgatctgataaagggtgcatttcataacgagcctgtgaacctgctacaacccaagcatagcgacagggtggagttcctaattcatgttcagccatcatgagcaacttacgagcaaatgcatcagcgataagcgtcatcacgtgcataatattattataagcgacacctctctctagtaaagcacggaataaatcccgttgctgtttagctatttctacaagcaaaggcagcgtatttgcttgaaaaatacggttaatgataaaaacagattgcatactgttttgttttacaagatctgtggcggttaaaataccttgaactttatcatcaacaatcaccggcaagctacgaatattatgttgcatcatcatggaaatagcttgtagtactaattcatcaccactaatcacaggaggattaatgttcatgatttctgtcactaacgtatttacatctaagccttgtgctacaacttttttggtcatatcccgatcatgaataatgccaatcaatttgttttgttgcatcactaaagcagaagaacggcgttgttcacacattctaatcgcagcttgttgtaatgtcgtattcgtatcaacaagagcaattttaggattagcaatatcaatcacttttttcatgaaaatatcattttgattttttaaaaagttattttttgccaaactgtttagtctttttcctgcatcagaagaaaagtaagaagcgtactcaggaaatttttttaaaagttcatttaagcgttgaaaaggaatttgataaattaacgtattttccaacgcataagcctgatatttatcttgctcgtgatgattgaaaatactgaaaccaaaacaatcgccactttccaatcttgctcttaattgtcctgatttattgacttgctccactgatcccatacgcacaatatacaagttttcattattattgaggctatcgatttcatcatttgtgattagttcccctttggggatataacgaatttcaatattctgtgcagcaagacgaattaaatcatgaggtaaatgtgtaaaagggggaacctgtgcaataaataattcgatattgggaataagtgagctatccatgtgagacctttgttttatcgaaagtgagctacaactatagcagaaattaacccgacacagctgcatcgggctaattacatttagtatttttgagaagataattagtttttacgatttttccataatttaattaatcttctataacgctctgaggtttctttgatgagttgctcatcatcaattttaccagctaaccaatcagccgaaggttgtccaaaaattgttctgcctacagcaaacccttttactaaaggtgcgtttgccgatgctttaaacacattctcaaagactgcttcaggtgcgtctaagccaaggattaaaataccacgacaatgtttgtcatttttttcaatgacttgactgatgtctgcccaagtttttgcggacactccaggtaatttccaccaatccggtttaatgccgagagaatagaagtgggcaatcatatcggtgtagtaactttctttttgctccatatccgcaggcaaaatgatctccagtaataattcgtgacctgtacgacaacaagcacgataaacttcttttaatgttgcatcttgatctgcttttaactctgccttgtctgccggatgatagaatgctaaacatttaacgacatgttctgcgggccaactaatgagttgactacctaaatcaccatgctctaaacgcaatggacgagaagatggcatttctattggacgaccaatccaccattttttaccagtaatttcattgagtgcttcttgaccaaatgtggtatcagctaaaacgccggcattgccattataaatcccctctttttgagcggtttgttctgcggctttaagcaataacgttttgagtgttggaatacgtttcaaatctgcaccgcacttttcagccatatcaaccaattgtttacgatgatcaaaggcaaaaatacataaatcatgccattgttgcttgcgtgttgtaacacggtgtaaatggtttaattgttcgtctaagtccggtcgaggtaccgattccgcacgggagagataattatctaattcttctttagtcggcattgccggggcacaaccatggcgagagacgaccaacgcaccgcaagcatttgcataacgacaacattgctcccaactttcaccgttaatatagccacgtaataaacctgacataaaggcatcgcctgcacctaagacattcaaaacttcaacacgtacgccatatacattaataccaccgtcaatatgattcggaatatcgccctcaaagacagaacaacctaatgccccacgtttgcaaactaacgtagcgttactgactttacgtacattttttaatgcagttagcgtatcagttgacccaccagcaatatgaaactcctcttctgtaccaactaagacatcaaagtgatgtaaaacttcttgtaaagattgtgtaacggcttcagagtcaataaaacgagtttcaccatcacccaatgaagttaatccccaaagtacaggacgatagtcaatatccagtaaacgttttgttccattacgacctgcgtattcaagtgcggttaaaaccgcatggcgagtttttggatgggataaatgcgttccggtaatagcaagtgcttttgccgaagcaatatattcttcatcaaaatcatcagcggtgattgccatgtctgcacaattatcacgatagaaaattaatggaaaagtatcttgatcttttattcctaaaatcactagagcagtcagccgctctttatccgtaatcaaatggctcgtatctacacctagacgctgcaattcctcacgtaagaaacgtcccatatgttcatcacctacacgagccaacatagatgattttacaccttgtacagctgttccataagcaacattacctgatgagccgccgagatatttagcaaaagagctcacatcctctaagcgtgaaccgatttgttgagcatataaatctacggcaactcgtccaagacaaataagatctaatgttttttcttttttcattgtgcttctccttgcgtgatgaagtcatcacaaaaaacggatatagaataaattatcgccttaaattgaaacatatatttcaaaaatgtctagaaataaaattaatatttgagatattgatcacaaagattagctatctcgctggtatataaagtcttttaagtaaaataagaatgaaatttccttttcaaagtggtataaatttaacttattactgagagaaatacaaaggaagagatagtatgcaagaacattctcaactcgttacattacaaaatgaaatccgttcacgttattcgactttgagtaaacgtttgaaacaggtagcacaatatgtccttgataatcacaatagcgtaatttttgatactgttgcgacgatatctgaacgtgccggtgttcctccttctacgcttattcgcttcgcaaatgcgtttgggtttagtggctttaatgaaatgaaacaaatttttcgtgaaaatttgattgaagaaacggcgaattatacggagcgtttacaagttttccgtcagctggaaccggaaaagagcgagcaacataatctgcaagatattttgaatatttttgcacaagccaataatcaagcactaaaacaattaagtagccaaactaccacaaaacagttaaaaagtgcggtagaaatattaaaaaatgcacagaatatttttatcattggattaaaacgttcgtttagtattgcctgttatttggattatgtgttgcatcatttagattgccgttcttttttaataaatggattaggcggtatgtttgatgaacaattaatgcaagtgaaaaacggtgatgtcatcgtggcggtgagtttttcaccttatgctaaagaaacgctggaaattgttagtgcaacctcacaaaaaggtgtcaaacatattgctatcactgatagtcaaattagtccattaattgcctccagcgatgttgcttttgtcgtgaaagaagcacaggtaagcggcttccgttcacaatgtgctacgatgacattggtacaaactttggcgattttattaggcttagaaaaagagaaagaaacacaaaattcttaaaaataacgattaagacttggtgataaatgtcagcaactaagttttgagataaatatcaaaacgatgatttttggtttggtgactgaagtgcggtgttttttttgcaagaaaatctgcgtaatcgggacgctttactaccgctcttttttgtgcgagcaataaggcaggttctaataacatatcagcatccaaatctgcaccgattaaatgttgaaaaatacgcatttcttttttaaccaatgcacttttttgtttatgaggatacatcggatccaagtagacaacatcagcaccttcttcactcgaatttaattcttgaatatgtgctatgtccagcaattgcatattcgcctgcatcatagtccctatttctacatcggcataagcacgcttcaagccgtcttgtaataacaaatggactaccggatggcgttcaaccaaacggactttacaccccaaagcagccagcacaaaggcgtcacgtcccaaaccggcagttgcatcaataactgtcggtagataattacctttgatccctaccgcttttgccacagcttcacctcgaccgcctccaaatttacgacggtgagccattgtgccggtcacaaaatccacataaacagcaccaagtttcggctcatctaatttgcgtaattccaagcgaacctgtccttccacttttgtttgcaccagtgctaaataactattaggatcgtgaatcaaacctttttgttgacaaagtgcggtaaattgcaccgcactttctgtttcacaaattaattggattttttgattaaccatacaccactttccatatgctctgtataagggaattgatcaaacaaggcggctttttcaatacgatgagttttagttaattcttgcaaattttcacataatgtatatggattacaggatatatataaaatccgctcatagttttgcactaattttaccgttgccatatcaagtcccgctcttgggggatcaacaaaaatggtattacattgataatcttgtaaattaatgccttttaagcgattaaatgcacgcacaccgttcatagcttgcgtaaagtcctctgcggacatacgaataatgtgtaaattatcaattttatttgctgcaatattaaattgagccgcacttacagagggttttgcaatttctgtcgctaatactttgcgaaagttttgtgctagtgcaatagagaaattgccgttcccgcagtaaagctcaagtaaatcgccctgactatttttagtacaatcaattgcccatttcaacattttacaatttaccgttgcattaggttgagtaaagctgttttctacttggcgataaatatactgttgatttttgacaggcaaaatttcatcaacaaaatcttgctgtaaacaaattttttgtttatttgcacgaccaataatttgtacatcaaatccttgttttatcagttgttgtttcaattgagttgctgcctgtagccattcttcgttaagtgttttatggtataacaaactgacaatgatcttgttgctcaaagtactgagatagtcaatttggaataagcgatgagttaaaatattgtgttgtttaagcaaaggcaataacgccagcatcatttggttaatcaactgactggcaataggaaattgatcgatacgaaaacgttgttttgttttttgatcaaacataatatgatagaaatcatcttgttcatgccaaatacgaaattcggcacgcatgcggaaatggcttgtttcggaagcaaatacgtcaagcggtggtgaattaaaaggtgctagaagtgcggtcagcttttgttgtttttctgctaaaagtgcggaatattgttcaataggtaaacgttgcatgatcttcagtattgagctaaaaatgaaaaggtgcgaatttcgcaccccttttacttaatcttaagttattcggcagagaaatcatccggattgtcagcaccaacaacgcctgataatgtgtaaacacgtttactggcagaaatacgagtgcggtatttattccaagttttctcaaaatatgtttctgccgggcgttctccacgacagaaagcaacgaaagctttttcttcttccgtaactggtacacgctcacctaaatctaacgctttaaatgcttgaccatattgctctaacgtttgagattcacgaatggtgtaatcaccatgacgagcaaaacctcgtggataatttttatcatcgaaaaaacgacgtgtaacactaaaactctctgccataatatcctctatcttattttgtaaaaatcggctcgcattaaatcaattttttgttatttttgcaataaacctttaacagtttctacataatccttgataaaaccgtctgttgtacgggataaaccttctgagtttactttatatttaccgttaatataaaattcaggtgttgctcttacgccaagtttttttgctaaggcaatttgtttgtttgtttgagcggtgacggcaaaactattaattcctccgtcaaactgtgccgcagtaataccgtttgcgagaaacacttcacgaatattgtctaaagtaggtgcttttcttttttcaataatcaattcaaatagaggcattttaactttttcttctatgcctaagagaattgctaatgaccaagcacgaacaatatcttcgcccatccaatcaacatgatattgtttgaaagtgacatctttgggcaaatcagctttaatttgttgtggaatttgatatgttttttcaaaattaaaacaatggatacaaccaaaagagaaaaattcaatcacttcaggttgaacggaacgaggctgctctagttcaatatactgttttccttcttgtaatactaaggcttgagttgaatttaaaaagaaaaaagaggctaatgcccatagaaattttttcatgtaatactcctaatcaataatgccacgtgcttttaataaggctgttttaaaatcgtcttcataatcttttttgatgccgggaataggctcatttttatctgtaccatacatttttaggtgataaataataacctcgtcggttaattccgcaatgggcttatcaaaaccggtttcctctgcaattttttgtaaaacttggattaaatgtaaatccggattgttagaccaatagggctgtaaaagttccaacacttcgtttaaacgatgacatttcataaagttttccttattatttaacccaaacagccgacaatcatacttgaaataggtaaagaagaaaatatggcaacaacaattagtgcagtaattttagctggtgggcaagctaaacgaatggctgggttagataaaggattacaactgcttcaaggtaagcctctctatcaacattgcttgcaaaggttaaccaatcaagtgagtagtatttctattaatgctaatcgtcatcaagctatttatcaacaaagtagggtagaggtttttggtgatgaattggaggattttcaaggtcctttaagtggaatattgaccgcacttgagcgagctaatacggattttgtgctttttgtgccttgtgatagcccttttttgccgttgaatttatgtgaaaagttgcaaagtgcggtggagaattcgaaaagtttattagcttatgcaaatgatggtgaacgtgaacatcctgcttttagtttattgtccactcaacttaaattaccgttaagagcttatttgcagtccggtcatcgtcaaatgttacaattttttcgtcaacataagggtatttctgtggatttcagcttacaaaaacaggctttcgtgaatataaacacattgcaggatattgaaaaatatcaaaatatttatgcttaattttttgttttaattattaattaccttaatttgatcataaatatatgaaaaatcattttttttactaagcaattagagtagacttcccctccgttgatatattacataggaataaaaaatgttaagcaaacaacaatcattaaaagaactcacatttcgaggaatgttattgggggcgttgatcactgtggtatttacggcttccaatgtatatttgggtttaaaagtagggttgacttttgcctcatcagttcctgcagcggttatctcaatggcagtattaaaatttttcaaggggtctaatattcttgaaaataatatggtacaaactcaagcatcttcagccggaacattgtcttccgttatttttgttatccctgctatgttgatgctgggatattggcaaggtttcccttttgggcaaacattattaatttgtatttccggcggtatgctaggggtaattttcactgtgccgttgcgtaatgtcatggtagtgaaaagtgatttgccttaccctgaaggcgttgccgcagcagaagtattgaaagcgggtaatgatgaaatcggtggaagaggtgtcaaagaacttacaatcggtggtctgattgcagcggtagccgggtttttaactaatggtttacgtgtaattgcggatagtgcaagtctttggttcaaaggtggaaatgcaatttttcaagtgccgatgggtttctcactcgctctgttaggtgcggggtatttagtgggtatgattggcggtttagccattttattaggcatttttgttgcttggggagtagcagttccttactttacttctgtcgctcctatgccagctgatgccgatatgataggttatgctttcagtatttggaaaaataaagtgcgttttattggtgtagggactatcggtattgcggcaatttggactttattggtgttaatgaaaccaatgattcaaggtatgatcgagtcatttagagctttgaaagatccgaatgcaaaaaatactgaccgcacttcccaagacttatctccgacaacgctgattttcaccacgttagtaagcgttgtattaattgtattggctttatatagctttataaatcctgtgggtattgaagccggcacggcgatcattttaattttggtttgtactttacttgctgtcgttatcggtttcttagtagcagcagcgtgcggatatatggcaggtcttgtgggatcatcatcaagcccaatttccggaatcggtattatttctgtggtaacaacttcattagtgttaatgcttgttggttctgctacaggtttattagacacggcggaaggtcagaaatttttgaccgcacttacgctatttaccggttcaatcgtggtttgtattgcggcaatttctaatgataacttacaagatttaaaaaccggtcaattagttgaagcaacaccttggcgtcaacagtttgccttgattatcggtgtgattgtgggggcgttggttattgctcctgtattggaaattctttatcacgcctatggttttgccggtgcaatgcctcgtgaaactatggatccgagccaagcacttttcgcaccgcaagcaaccttaatgatgactatcgcaaacggtattttttctcataatctcgaatggaactatattttctttggtatcggctttggtgcggttttaattttcatcgacagcgtattgaaaaaggcgtctaacaaacgtttagcgttaccagcattggcagtaggaatggggatctacttaccgccgtcagtcaatgcaccaatcgttgtcggtgcattgcttgcttggttgattaatcgtcatttagaaaactttgcgaaacgtacaggcaaagatcttgctgatgtgaagaaaaaagcggaacgtttcggcacattatttgcagcgggtttgattgtgggtgaaagtttaatcgggatattactggcatttattgttgcaggttccgttacttccggaggttctgatgcaccgctagcattacatttagaaaactgggagagtctagctcaagtattaggcttaatgatgttcgctacgggtataacaatctttgcattacgtgtactcaaggcgaaacaataatattgcgaaaattaaataggacttgacaaaaaacctccagatttagaaagcggaggttttttctacacaattttgaaacaagaaaactaagtaatattcacttcataacaatacctaacgattaacgcacaccctgtttatctaatctggcgaaatctttacatccttgagcgttgccgttatcacatgcttgaccgtagaatgttttagctgtagaaacatttttttgtgcccctcgtcctttttcatacatatcgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtgaaccaatagactgcttgttgatagttttgagcaacgccttgtccgtttgcatacatcacgccgagatagagttgtgcttctgcaatgccttgttcagcggcttttgtccaccaatagacggcttgttgagagttttgcgtaacacctagtccgttcgtatacataaagccgagcatagattgtgcttttgcatctccctgttcagcggcttttgtgtaccaatagacggcttgttgagagttgtgtgtaataccctgtccaaacatatacattgtgccgagcacagcttgtgcttttgcatttcctttttcccccagttgtttgagtaagggaaaagcggcagaataattttgttgtttgtaaagttgagtagctcggtcaagtttttcgctattggtttcggcaagtgcagattgggcaacaccgaaagagagcaaggcgataagtagggatttttttaggttcattttatgttccttatttgacgattatttgaattcaatacacaaagtttgtggattgagaaaacattttcttcccgtttcaagaggggtgattggattcaaaatatttaaattagaatcaaataattgagagctgccattagcaatcattttattgacgatttcatccacctctttttgttcattaggattgatggcttttatattgtcgtaaacataaggcgaatctgaggtatctccaaaaaaattcttataaataccaacagtaatttcaatacgatttgacatggttttttcctctgatttgattttatatgtggcgttcgctacctactatcaagtaggtaggatgtagagtatactctacatcctttgacgtcctcccctagctaaagtaaggagattcctaccagctcccacagcaagctgtgggctactctcggagggtttctgctgctgaccgccaatgcgattcacttcacagacgctacgggcacgtcctgccctgattatgccgtcattgagagtctaaagcgacctctgttagcagtaagaagtatatcatatttgtgccttatatccatgccctaaaggacgtggttttatggcacgattagataaaggattgctaaaccctttgctcggtgtcgattggtctattgagtgttatttatacagcagtatattaaaaaacaactccggtttgaaaaccggagttttttatagatattaggcaaaagtatctaaatattgatctgttatttgggagacttatttgactagcccgccacttgcttgtaagtcagcatgatacgaagaacgcacaaaaggtccgcaagcggcatgctcaaatcccattttttcggctttatcacggaaatcatcaaattcctcaggtggaacgtatcgggcaacaggtaagtggtggcgacttggttgcaaatattgacctagagtcaacatggttacaccgttatcccgtaagtcctgcattacctgtaaaatttcttcattggtttctcccaagccaaccataatgcctgatttggtagggatatgtggaaaaatggttttaaattctttgagtaattttaacgaccaattatagtccgcacctggtctgatttcacgatataaacgaggtacattttctaaattatggttaaaaacatcagggggattatcttttaatttttctaatgcttgctcaatgcgtccacgaaaatcaggcaccaaaatttcaattttaatacctggattaagtttgcgaatttctttaacacattcagcaaaatgtcccgcaccacgatccggtaaatcatcacgatccactgatgtaataacgacataacgtaatttcatatcttgaatggtttccgccaatttttttggttcatccggatctgggggtaatggttttccatgggcaacatcgcagaatggacatcggcgtgtacaaattgcacctaaaatcataaatgttgctgtgccgtgattgaagcattcatgtaaatttggacaagacgcttcttcacatactgaatgtaatccatgacgacgcattccgtttttaatactgttaattttcgcagaatttgcaggaagcttgattttcatccattcaggtttttttaataactcctgatttggatcgatatttttaaccggaatgattgacgtttttgcagcatcacgatatttgacaccacgttccattttaaaaggggttgtcattaacagatcctaatttgttaataaattgttacatcattatagcccaataattgcgtaaagtgtgtaactaatttgggtgcaactttatcacattgagcttgttcagtgggtataaaatctgccatttggcacatttctaagcctatatagccacaaggattgatttgtctaaatggcgataaatccatgttgatatttaaggctaaaccatggaaagagcatcctttacgaatacgtaaaccaagagaacaaattttttgttcatttacatatacaccgggggcatcagctttcggataacttttaataccataatcagccagtgtgctaaccactgattgctcaagagcggtaactaattgacgaacattaagttcactgccgtttgctttgtgacgcttaatatcaatcagtacatacataatttgttgtcctaagccatgataggtaatttgccccccacgatcggattgtaccacaggaatatcggttggattgagcaaatgttcaggtttacctgcttgtccttgtgtaaaaacagccggatgttgaactaaccaaatttcatcagctgttagcacatttcgagtatcagtaaattctcgcatttgttgccacatttgttgataatcttggattccaagttggcgtataataagagtagtatctgtcattttctgtcttaaagtaccatgcgtacaccatcaattttggctagttcagtatagagaatttctacttgttcaatattttccgcaatgatatctacagaaattgaattataagttcctttgctactgatattttgacgagggttataatcacccttagcgtatttttgcgttaccataactacatcatcaattaaatctgctcggtttttaccaacgactttgaaagtaaaagagcaaggaaactccaacaaatcttttaattgtttttgtggaatgtcgttaagttttactgttttgtcagtcataaaatttccttaaagtgaaaatatgccgaaaagtgcggtctgatcttattgtttttagttaaacaaaccttttactgttaataccagccagtcccaaagtttgctgaaaaatccgccttcttgaacttcagacataatttttaagtttgcacttgcaatatcacgaccatctaattgataaataattttacctacaatttgtccttttgctaacggagctgttaacattttttgattaagctcgtatcttgttttaacatcattctggcgacctttaggtaaagttatataagcatcttccagcaccccaagttgcactttgtttgtattaccgtagtaaactttttcttctacaatagattggtttgcctgtaaagatttgaaggtttcaaagttagcaaagccccattgtaacaattttttactttcaatttcacgacctttgtgagtagcaacgcccataacaactgaaattaatcacatattgttattatttactgcagaggcaaccaagttataacctgctttatttgtatgtcctgttttcataccgtctactttgattgatttatcccaaagtaaaccgttacggttatgttgcttaattttattgaaggtgaattctttttcagcatagattttatattcttcaggcaggtcatgaataatatgacgaccaataatcgccatatctctggcagatgaatattgattatcatcatccaatccatgaacggtcataaagtttgtattttttaaaccaaatttagcaacatatttattcattagttcaataaaattacgctctgaacctgctatatgttccgctattgccacacaggcatcattaccagatacaatcactatgccacgatttaaatcagctactgatacttgttggtttaaatttaaaaacattttagatgaaccgggaaaattttcccccaagcactttcatcaatggttacagtgtcggttaagctaattttaccttgtttgattgcatcgcctacaacataacttgtcatcatttttgttaatgaggcagggtgttgacgctgatccggattaaaggcggcaagaactgcacctgaatggtaatccatgagaatatagctttgtgcacttaattccggtgaagcaatgccatattgaatatcttgggaaagtgcaggtaatgaaattaatcctgacatcagtgcaatttttgtttttttcatcgctttttgtaacattttacatcctttaaaaattatttctcattgtaagagatggtgataaattaatgtaattggcggatttatttaacctatctttaaaaccttattgctaagatttaatgtttttacgtgttttagccaacgtttttgtacccggtccggaaatttttccataagcatcaacatataatgattctacctttacttttgctatgccagcatgaatcattccaagctcttttgcggcagcttcagataaatcaataattcgtcctttgctaaaaggtcctcggtcattgattcttacgatcactttacgattattgcgtaaattagttacgaccacataagagtttagtggcaaagttttatgtgctgctgtataggcattattattaaaaatttcaccgtttgcagttttacgtccatgaaattttttgtgataaaaacttgccattcctttttgtgaataattttttgccttctcgtagggtagtgttgtatatctaacgcctttgactacgtaagtatagggctttttactcagtttttgatagactagcttagctccttcaatgccatataattttttcgtatccgcctgtattgacagcgaaactaatgccataaaaagtgcggtgcataatttaaatattttgtttgacttcatagtaataagtttaatattgattgtgttatctaagataaatatttatttagttcctttgaaaaagttatttttatgtgtatgaatggacatgatcaaaccaaatccagccattaaggtaacaaaagaggttcctccatagctcattaaaggtaaaggtactccaactacaggtagaatgccacttaccataccaatattgacaaatacataaacaaagaaaattaatgtcaatgcaccacttaaaattcgtccaaaagaattttgtgcattaacaccgataattaaccctcttgcaacaataaagagatagatgagcattagtattgtaaatcctgtcataccatattcttcacttaatacagcaaaaataaagtctgtatgtggttccggtaggaattcaagttgcgattgtgtaccttgcatccaacctttaccccaaatcccccccgaaccgatggctatttttgattgcataatgtggtagccagcacctaaaggatctttttctgggtctaaaagagttaagactcttgtgcgttggtaatcatgcattaaatagagccatacaattggagtaaaagcagctaagcccacaatagcaattaagatgaaccaccagttgattccggctaaaaatacgacaaaaatcccggatgcactgactaaaattgacgttcctaaatctggctgaatagctactaataaagtcggcactattattaataataaagcaataaaaatttcacttaatttaggtggaagaggacgttttcctaaatatgttgcaaccattaatggtactgataatttaacaatttcagagggttggaaacgaaaaatccctagatctaaccaacgttgtgcccctttacttgttgttccaaaaagatccactaacagtagtaaaattacgccaatgacaaatccataaggtgcaatacgttgataaaaccttggtgaaaattgtgccatcacaaacataacagtaaaaccgagagcaacttgaataattcggttgcggaacattttttcactgcctcctaccgcactataaagtacaagcaatccataggaggaaatggttactaaccctagaaaaagccaaaaatcaatatgcaaacgacgccacaaaatcagccaaatattttttttctccatcaactttttcctttttcatttttcctttttcattttgtgattgtacttgtggcaaacggatatttaaataataatccataatttttcgaacaacaggtcctgccttagtgctaccaccaccggcattttccaaaataacaacaacaaccattttaggattgtcataaggtgcatatccgatgaaccaagcatgatcgtgcaatttattatcaagttcgtttgcattgtaagtttgattttctttcaggctgaaaacttgagccgttcctgattttcctgcaacaggataactgacatcaataaaagatttacgtcctgtaccattcggtgcgtgtattacattatacatgctttgttttatcgtttcccaaaataccgcttgaggttcagtaatatcttcgtaaagacgaggatcttgatagggttgcatttctgacccttcaattgctttcattaagtgcggagtattaaccttgccattattaactaaaactgcagttgctttggcaacttgtaatggggtggctgtccaataaccttgaccaattcctacagaaatagtatcaccctgaacccaaggtcgtttgtagcgtttttgtttccattcccgacttggcataagtgcggcggtttcttcttgaatatcaatacctgttggcacaccaaaaccaaagcgtttcatccactgagataaacggctaatgcccatgtcgtaagcaagttgataaaaataagtatctgaagattctactatagctttattcaaatcggtgtagccgtgccctgattttttccaatctctaaaacgtttggtggtattaggtaaaatccaatatcccgggtcaaatatcgtagtatttgtggtaattaaattttcttgcaggccagcgatagcaacgaaaggttttatcgttgaagccggtggataagcaccttgagtcacacggctatacaaagggcgattaggatctgtcagtaattgcttgtaatccgcacttgaaataccgccaacaaaaagattgttatcatagctcggggtagaaaccattgctaaaataccgctatctttaggatctaatactacaactgctgcacgaagattgcccaataaatttgcgatataacgttgtaattctaaatcaatcgttaagtgaatactttttccggcaatagcaggctgttcccttagtttgcgaataaccttacctctattattcacttcaacttcttcaaatcctactttgccatgtaagtcatcttcatagtaacgttcaataccgagcttgccaatatcatgagtgccggcgtagttggcgtatttttcatttttctttaaacgtgctacatctttttcattgattttagcgacataacctagaatatgagtcaacggctcaccatacaaatagtggcgtttaaagtaaggcctaatatcgaggctgggatagtgatattggtttactgcaaagcgtgcgatttgttcttcgctcaaatctcctttaaggagaattggcatatatcgggatgagcgacgacgttcctttttaaagttctcaatatcgtcatcatttaaaccaacgatatagcgtaactcttcaaaagtgcggtttaaatcctcaactttttccggcacaatatataagccgagaaaggtaatattttccgctaataatttgccgtagcggtcgtaaattagccctcgagtcggtggcaaaggaagtaatttaattcgatttccgttagatcttgtctggtaagtttcgtaattgacaatttgtaaataatacaaattggtaaataaaagtgctgataaacccaatacacctagaaaggcgataagagcacgacgagcaaaaaggtttctctccgcctttttatctcggatcggtgtttgtagaggttgagagagtaatttttttaaattcataaaatattaaccgcacttattctcggtgataaggatgatttgtgcttaacgaccaagcacggtataaactctcagccacaacgatacgtaccaatggatgaggtaaagttaaaggcgaaagagaccaactttgttctgtcgcagctttgcattcaggtgataatccttccggaccaccaattaagagtgcaacatttcgaccgtcatgtttccatgcttctaattgctgtgctaattgctcagttgtccaaggtttaccgggaatatctaaggtaataatacgacttttctgacaagcggataacatagctttaccttcttgttcgagaatacgtttaatatccgcattttttccacgttttcctgccgggatttctattagctcaaaaggcatatctttgggaaaacgacgttgatactcctcgaagccttttgtgacccaatcaggcattttagtgccaacggcaattaattgaattttcatagattaataagtgcggtcattatccccaaagtttttccagctgacacatttcacgactgtcagcttgcataatgtgtacaatggcttgaccaaaatctatcgcaatccaatctgcggtagatttgccctcttcgccaaaagtatcaatgccggcttgcttactctcatcaattaatttctgtgccaaagagattacgtggcgacttgacgttcctgtacataaaatcatgtgatcggtaatagaagatttacctctaacatcaagggctaaaatatctgtgccttttaaatcatctaatttactcactagaaaatcgactaagttcattttttctcttctcaattgcttatggttatttgcttaaaagtgtgtaatgttagcatgatttgggggagctaggaatatcgtttgatagtgtaattgtatacaaagaacgctcttttacttatataaaaaatttttctgtttataaatgatttctcggacagcgattggaagaaatgagcgtgtgtttattatttaggttcacaaaaatctcttatgtcagtaatgccacatacattgaaagcacatctgtattggttttcactaatgttctttatcaagaaactgcacctattaatggtacagttgtgttttgtcaaaaatacaaagtgataatatgtaattctaaatttttctaaatattaactacacgcatcgcgatatatttactataacctaaggcacataaaaaaaggcttgcttgaagtaagataatacaaggtcctgtggcgacgttgaaatgaaaactgagcaatacgccaaaaataccactgaatactgctgtgcaaacggcaattagcatcatataatcaaagcgtttagctaaaatatagcctgttatcccaggtgtaatgagcattgccaccactaaaataacgccaacaacttgcattgcactgatgatgactaacgctaggattaccagtaaaccatagtgtaaaaatttggtgttaagtcctgcaactcgtgtgtgacttggatcaaaacagtaaagcaacaagtctttgcgttttaaggcaatcaggataaatgccagtaatgcaatgccaatactttgccaaaattcttgcttaatgatacctagaatatttccgaacaaaatgtgcattagatgttgatcggtttccactttggaaaacagcaccaaaccgaaagcaaacattcctgaaaaaacaattcccatcactgtgtcttctttgattcggctgttatctctcaaataacctacggaaactgcacaaaagatgcctgcccaaaatgccccaatcgcaatcggaattgctaatacataggcaagaataattcccggcaatacagcgtgagaaatggcatcacccattagtgaccagcctttaagtactaaataacacgataaaatcgcacacactgccccaatgataggtgcgatgataatagcttgttgcataaatggatacaccaagggctcggtaaaccacgctacaatcgtattaaacatttggcttctcctgatttgcaagatttggtgaggaagtcactgctttttgtgtacttcgcttacgtggaataagaccatatttgggagcaaaaaagaaagcaagcaagaagatgaacgtttgcaatgatacaataaagccaccagttgcactgtctgcgaaataactcaaatatgctcctagtgagctagtagtaccaccgagtaaaatcgaaataatcaacaggcgatcgaagcgatcggtgagcaaatatgctgttgctccaggtgtaatcaccatcgcaattaccaaaatagccccaactccttgtaaggcggttacaatgcatgcacttaacaaggtaaagaataaaattttgaattttaaaggcgatagccctaccgctttggcttgaatttcatcaaagaacacaagcattaggtctttccaaaagagtagcaacaatacaaatgatataccgagaataatagcgacttggatcatatcttcatcggcaatacctaaaatattgcccaaaacgatagattgtacgttcacggaagtgggattaattgaaataatcaacaatccgagagcgaagaaagaggtgaaaataaaaccgattactgcatcctctttgagtttagtcacgtatttcactgctaaaatggcaatggtggcaagtagcccagagaaaaaagccccgacggcataaggtaatgccaaggcataggcaatagcaacgcctgggacaacggcgtgggataacgcatcaccgatcagtgaccaacctttcagcattaaataagcggaaagaaaagcacaaaccgctccaatggcaccactgaccacaatcgccttaaacataaaatcataagaaaacggttcaagtaatagctctaacatcgcattactccgcatcttgaataaaatgttgataacgtaaaacgccgccaaacacacgagctaaattttcttgagtaaaagtgctttcgattgatcctgcagcgagtagtgtacggttgatcatcaccgcttgatcgcaaaaacttggcacggtgctaagattatgcgttgaaacgagaacgagatgaccttcctgacgaagctgtttgagtaacgcaatgatggcattttctgtgccaacatctacaccagtgaaaggttcatctaataaaatgatttggctttcttgtgctaatgcacgagcaagaaatactcgttttttttgccctccagaaagctcgccgatttgtcgatctcgcaaatgagcaatattgactcgctccattgcgtctaaaacttttttcttgtcttgtgctttaggcatacgaaagaaattcatataaccataacgccccatcattacaacgtcataaacagaaacggggaactgccaatccacttcttcactttgcggtacataggcaattaagttttgttttaatgcccgattagcgggcatgttacaaatttcaattgaaccttgaggcttcactaagcccataatgcttttgaataaagtcgattttccacttccgttaataccgagcaatgcacaaatcgtaccaccttcaaggtggaaactcacatcgtgcaacgccgtatgaccattactataacgaaccgtaatatctctgacagaaagagaactgatgtgagttttcattcaattaccttattttttgaaaccattcacaatggtcgaaacagttacatttaataagtcgatgtaagttggtactttaccatcttttgtagaaagtgaatctacataaagtacaccaccgtattttgcattggtttctttagccacttgttttgctggcttatcagaaatggtgctttcgctgaacacaacagggattttgtgttcacgtacttttttgattacatttttgatttgttttggtgtgccttgttcttcagcattgataggccataaataaagctctttgaaaccgtagtcgtgagctaagtagctgaatgcaccttcactggttactaaccaacgttgtgaagctggtactttttctaactcagcacgtaatggtgcgtctaaagcaacgattttatctgcataggcttttgcattagcattgtaagtgtctgcatttttaggatcgtatttcactaaagcttcacgaatgttttcgatgtataccaaagcatttttggttgacatccaagcatgtggattcggcatacctttgtatggaccttcgtagatagaaattggatcaatccctttagttacaacaacagctggtttatctttcacttgggtaaagaaacgctcgaaccaacgctctaaattcattccattccaaagcaccaaatcagcagattgtgcttttacgatgtcttgtggagttggttcataatcatgaatttctgcacccggctcagtgatcgactcaacaacagcagcatcaccagcaacattctgagcgatatcttgaataacggtaaaagtagtaactactttaaattttgcgtaacttggtaaactgaatacagaacctaagattacacccataacaataagtaaacgtgacataatttctccttcgaattaatattagaaacaaatttgcatttcaagcgaactcggtcttgcatagtactgcaaaaataacttattgtaaatagcaataattatcaattaaagacattttattggtttgggtaaaccagctaattttgaagcttgttttgcgggaccttctgggaataaacgttgtatgtaacgactattgcctttatctgcacctagcttttgtcccaatgctttgactaacattctcattgctggtgaggttttatactcttgataaaaatcccttacaaagttaataatttcccagtgggcttcggttaattcgatattttctgattttgcaatggctatagcgacatctttattccactgattcatatctaatagatagccctcaacatcagtttcaatttgaacttggttaacacttaacatatgttactatttttgtccttttgatatataaaaagtaaaaagcccctattcaaggggcataaaacaagtttaatcaattattcatcacggttgaaaatacctagtaaattgagcaagctgacaaaaagattgtaaagtgaaacatacaaactaaccgtagctctaatataattagtttctcccccatgaatgatattgctggtttcatataaaatagccatagttgagaaaacgataaataacgaactaaatacgatgtgaaagccactcatattaaagaagaaacttgctatcatgcctataaccagtacgataaagagagcaagcatcatgccggataagaatgacatatcttttttcgttgttagcacataggccgagcatgtaaaaaatacacttgcagttccggctagagcaagaacaaccaaatcacctaatcctgagccaacataatagcttaaaataggacctaaagaatagcctaataatcctgttaatgcgaatgtagataaaagtccccaagcactgtttgctaacatattattgaggaataataatccataaaaacctaccaacatgacaccgaaatgaagtggagggagatttaattgcattgcactgaaggcgacaacagcagaaaaagccaatgtcaatgctaataaaaagtaggtgttacgtaaaaccttatttgttgccagtaccgattcttctttagtatcaacaataaaacgagattgcataaaagctcctaggttgtagttgtaaataaaaagtgaaaagctatttataagttaatggttagcaactttaatgtcaacatgaatatttttcagaaaagagtaacattgaagtaaaattaaataaaaatggataaattatcaactcttaaaccataactgttatttttttagtttacttctatttctatctatattatattacgcctcgtcaagacggaggaatggtcgagtggttgaaggcaccggtcttgaaaaccggcgagggtttacgccctccgtgagttcgaatctcacttcctccgccatcaagttttactaagtcgtaagttatgcctctgaaatcagtaacttacggcttttttatatcaggttaattgtcgtaataacttgcttaaaaatcaccgcacttattggtctgatagtttccgtagcaaacgatccatggctcgatagcttaatgcttcagctaagtggttttgtttgatatcagaatctccgtttaaatcggcgatagtgcgtgcaacttttaaaattcgatgataagcacgaacagataaaccgagtttggttaaagtattttctaaaaatagtgcatcttgctcagtcaacttgcaatctcgctcaatttctttaccggttaaataagcattgacttttccggctctagctagctgaatttctctgacccttaatactttttctttaacttgtgctgttgtttcacctcgatcttcggtattttgcaaagcaccttgtggaagtaaaggcacttcaatggaaagatcaaagcgatctaaaaaaggaccggaaagtctgttcaaataacgcaacacttgttgtggtgaagtgcggttgtgtataccagtataatgtcccgttggacttggattcatcgctgccactaattgaaaacgtgccggaaactgaatttttgcattcgcacgtgaaataattatttctccgctttctaaaggctggcgtaaagcatccagcactctccgttcaaattcgggtaattcgtctaaaaataatacaccgttatgagccaaagaaatttctcccggtttcggaattgttcctcctccaaccaatgccggtgatgaggcactatgatgaggtgcacgaaaaggacgttgtttccaattttgaaaatttaattcgttttgtaccaaacttgttacagaggcggtttctattgcctcttgatctgtcatatccggtagcaagccagttagacggcttgctaacatggttttacctgtgccgggcggtccgagaaacaacaaattatgttgtccggcagctgcaatcattaaggctcgtttagcatgttgttgaccaataatattcgtcagatctttattagattgaggtgaaaaatctaccgcactttgcatacataacgttgtggatgaaggtagcgaactgtcgtcattcaggaattgtacgacctccaataagttccgtgcaaaaaatgtttcgtgttgtgaaactaaagaggcttcattagcattttgttgtgcgacaataagttgacgcttagatttttgccccgctaaaatagcagggattacaccgtgtacgcctcttaactcacctgtgagagccaactctgcaacaaattcaaattgttgtaacttttttgcattaatctgttccgaggccgctaagatgccgagtgcaataggtaaatcaaaacgccctccctcttttggcaaatctgccggagcaagattaactgtaatgcgttttgccgggtatttaaattgagcattgagtaatgcactacgtactcgtccttgagcctcagttactgttttctctggcaatccaacgagggtaaaagcaggttttccattactcaagtgaacttcaattgtcaccaaaggtgcttgtacgcccattgatgctcgactgtaaacaactgctaatgacataatttctcccaaatttttgagctaaaatataaaaaaagcagcgagtaaactgtacttactcactgcttttttgcgatccggatcgtaaaagtaaaaaagttttagctaaaaagcggagaaaaccattgatctaattttgccgataaacgttcgataccgattttattttgtgcggaaaaggcttcaacctgtacatcaccttggaaaggtaaaatcgcttctcgaaccatttttacttgcttacttctcgcactttgactcaatttatccgcttttgtgagcaacaataaaaccggtaaatctgcggagaccgcccattcaatcatctgttgatcaagatcttttagaggatgacgaatgtccattaaaataaccaaaccacctaaacattcccttttttgcagatactcacctaaagatttttgccactgaagtttcattttttcgggaacagcggcatagccatatcccggcagatctaccagcttacaattgggttctacttgaaataaattgattaactgagtacgtcccggtgtttttgaagttcttgctaaatttttttgctgggtcaacgcattaagtgcggtagattttcctgcattagatcgtcctgcaaaggcaatctcaatcccactatcctcaggtaataccttaatattaggggcactcattaaaaaatgggttttatgataattcaattttatatctgtcattttattttttcttcggtcgttgccagttggaaatatggcgttgtggaacacgagtaataactaactcattttcttgtacatctttagtaacggttgctcctgcaccaatagtcgcaccgcttgcaatggtgagaggtgcaactaattgactatcggaaccgacaaacacattatcgccaatcaatgttttaaatttattggctccatcataattacaagtaatcacaccggcaccgatattacaatgatgtccaatttcagcatcgccaatataagtgagatgatttactttagatcctttgccgatttgtgcttttttaatctcaacgaagttacccacatgagtatcttcattcaattttgcacccggacgtaatcttgagaatggtccaattttggcattattacccacaatggcatcttcaatcacagaataaggttttatttccacattatctgcaatcgtacaatttttcagtacacaacctgccccaataaacacattattgcctaatcgtaccgttccttcgataactacatttatatcaatttctacatctttaccatgagttaattcaccacgcaaatcaaaacgtgcaggatcagcgaaagtaacacctgcaagtaacaatttttctacttgcttacgttgataatgacgttctaaattagctaattgtaaacggttatttactccctctacttccataagatctttagcttgtaccgctacaactttgaagccatcttgattggcaagttctattacatctgtcatgtaatattcaccttgtgcattattattatctaaacgagctagccatttacggaaacttgcaccgtccgataccataacgcctgtattcacttccgtaatttttagctgctcaggattagcgtctttctgttcaacaattgccgttactgtaccgttttctcgaatcactcgcccataacctgtaggattgtctaaattaacggtcaaaagtgcgataccattttccggtttttgtgaaattaaacactcaagggtttccttgctaattaaaggtacatcaccatataacatcacaatattttcgtcatcttggaaaaaaggcactgcttgttgcattgcatgccctgtacctaattgttcagattggaatacccagtttacaggttcatcagccaaatgttgttttagtagatcagcaccatgtccataaattaaatgaatttgtgccgcacttaattttttggcggtatcaatcacatgtttaaccatcggtttacctgcaattttgtgcaatactttaggtaaatccgaatacatgcgagttcctttaccggcggcaagaataacaacgcttaatttgttcatgataaattttctctttgtcataataatcgatgtattttagcgtaaaacacatgaaaaaataatataatgttattatgtttagcaaacatacgttcttcttttatgcaaaaaaataatcactattatattggaattatgtccggtacaagtttagacggtgttgatatagccttaatggattttaatcaaagaccgcccaagctacttgcaagccattgtttctctatgccggaaaatttacgccaacaactcaccgcacttttaaaaaacggagaaattggcttacagcaattaggcgagttggatcatcaactgggattactttacgcaaactcggtacaacgtttcttagcacaaaatcaaatgaccgctgatagtattcaagccatcggttgtcatggacaaacgatttggcattcaccccaaggtcaatatcctttcactatgcaaattggcgatgctaacctgattagtgtactgacaggaattacgactatcgctgattttcgtcgcaaagatatggctcatggtggacaaggtgcacctttgtcccctgcatttcatcaagccttatttgcacaacccgatcgcattacggtagtgttaaatattggcggtatcagtaatatttcttgtttaattccggaacaagaagttattggttatgataccggtgtaggtaatgctttgatggatagttggattgaacaacatttaggggtgcctttcgaccaagacggtgaatgggcaaagagcggtagtgttcaccaagatttgctaaaagatttattggacgaacctttttttcaacaacttccccctaaaagtactggacgggaattatttaatttggcgtggttgaacaaaaaactgaaaaaacataccgcactttctgcacaagatgtacaggcaacgttgctggaatttacggtacaatgcacggtgcaagagctggttaaactcactaatccgaaccatttgccttgtttgttgttggtttgtggcggtggtgcaaaaaacagacaactaatggctcgtttacaagcctgtttaccgcaatggcacgtagcaacaactacagagcatggtttatcggttgattatgttgaagccgccgcttttgcttggttagcgtatcagcgtataaatcatttaccctctaatttaccaagtgtaaccggtgctaaaagtgcggtcagtcttggcgttatttatccgaaataatcatgaataaacaaaatttaattaatcagttcgctcaactaattaccgagcaacccaatccactctcagtaaatttggatcaaatgtctgcacttgaaattgtacaattgatgaataaagaagatcagcaagttccactcgtcatagcaaaagcacttccggaaattgccgttgtagtggaaaaaatcgttgctgcttttcgtcaaggtggacgcttagtgtatcttggagcggggacaagtgggcgtttaggcgttttagatgcctctgaatgtcccccaacctttggtgttaatcatgaaatggtaaaaggcattattgccggaggagaacaggctatccgttatcctgtggaaggcgctgaggataatcaacaagcggcaatagtagatctgcaagcaatccaattatgttcaaaagatattttagtgggtattgctgcgagcggtcgtacaccttatgtcatcagtggattaaaatatgctaaaaagatagggggatttaccgttgcaatagcgagtaatccgcaaagtgctatggcaaaaattgccgatattggcattgaaactattgtcggacctgagattttaaccggttcaagtcgcctgaaatccggtacggcacaaaaattggtgctgaatatgctaaccactgcaagtatggttttacttgggaaatgttatcaaaactttatggttgatgtacaagcaagcaatgaaaaactcgttgatcgagcgacaagaattattatgcaagcaaccggttgtgaacgagcgaaagcagagcaaacgctaacacaagcagataataatgcaaaactggctatcttaatgattttaatggatttagataagcaaagtgcggtggatttattagcgaaaaatcaagataaattacgccaaacgttagactgatttttcaccactacttttctactaaaaaggctgtcagtgcatttgagagatgagatagtttgtaaaaaataggcggagaagataaaataaagtggttcgaaactgtagattaaatctaactagttaatattgttcataaatattaatattcaatttataaacaaacattcggacatgaattgcaagctggatatgtatagtttgcaactgaaatatgatctcaaggaggttaaatgtctttattaaatatcattaaatcgtttttctcatctaaaaaggagcaagccatgccgaatattctcgtcatttcaggtcattcaaatttacagcaatccactgccaacagtgctattttaggtgaattggcaaataaccttccaaatgcagaaattcgtaaattagatgagctttatcccgatttcaatatcaacatcgaagctgaacaagcggcattattaaaagccgatattatcatttggcaatttccggtgaactggtaccatttcccagcgattatgcaaaaatggttatctgatgtgttcacttatggttttgcttatggttctgagcaaaaattaactggtaaaaaattgtatatttcttgtactacagcaagtccagaagaagcctatcaacacgatggtgcacaaaaacataccattgaagaatttagttatgcttatcagcaaactgccgcactttgtggtttagaattttgcggtattattcattctggcaatatgctttatattccgggtatgaatacagaggaagataaagaaaatgtaattgcaaaagcaaaacaacatgctgaacgtctagtaagtgcggttaaataacacatcatgttaatagacaaaagggacataatgttttatgtcccttccttgagtcaaaataacgataacatttcatcatcatatctttttttaaatctcaattttttctgtatttttttgaaaatctatatcgtataatactcagtcggtttaacgataacattaaactatgtaaacattacaaacattattttttctaaataaggggtctcttatgagatacaaattatctttagtacttttatcaatgctgcccgcactttcccatgcgggggggggggggtaatttcaacttttacggcaaagcgggaattgatttaacctctcgttttgaaacgatgaaaataacacaaaattacgatagtgctggcggttttaaattatcaattccggcaagttcaagacaaaacactttctcacccagtatcttctttgaaacgacttacaatatttttccgcaaacggaaattggtctcggactaggctatatcaaacgaaaaggctttgaccatattgcaatttggcccgtcgagggtagtgctgaatacgatccgagcggacagtttcatctgaaagaaacctatagagtaaatcgttatgcttccctaccaatttattttattttgaaacaaaattatgccttaaatgcaaatacaaaattttatctaaaaggcgatttagggtattcaattaataaaattcgtaaaacggtgtatactctctatggagatttatccttgggtagtatatgaggttacaaaaaagacagagattttgttagtaataataaagcaaagagcggtctgtatttaggcttaggtattgggattgaatataaatctttcttagtagatattggatattatcatacccattcgaaaatcacttataaagaacaagaaagttacgtatcaacaccctataacaacgatgcaatacgcttaacgcttggctttaaattctaaaaaataaaaaattaacggtcataaaataaatgttttatgaccgttaaacatattcgttaataatgtaatgctaaaaaaacatcaattattttctttaagtctaaattgttgattgcggtgttgcacaaatgagtagatgaaatacaatactgtcgctgcaccgaaacagtaataaccgatccacactgccggcaacacgtcttttgccatgaaaatatacagagaaattgaaataaatgtgatgactaaagaaacagcttttgcataagcccaaggttgaatatccacttgcttagtgtattcttcgttgtatggtgtttccattggcatgatgcgaccgataattagcattactactacattcacaacaaataagatagcgattaagtggaaaaaatggatctcaactttaatcacaaatttacataggatataagctaccataccaaatactaaaccgaatttagccgcaatcgctgggacacgttttgtcagtaaaccaaccaccacaacactcaaaattggggcattaaaaataccttgtaattcttggattaagaagaataaaccatccggtgcattggcaactaatggtgcaacaatcattgccatgattgctaaacctgtaccgacccatttgcccacgctaactaatttcatatcgcttgcatgaggattaatttgtgttttatatacattgcgggaaaataaagttaccgatgagtttaaggcactattaaaggtggataaaactgccccaacaacaactgccgcaaagaagccgactaacgcatctggtaagactaaatgaactaaattaggataagcctgatctggaatatctaatttaccttggtaaatatgataagcaatgataccgggtaaaatgattaataaaggtcccagtagttttaaaaatgcacataaaagaacacctttttgtccctcttttaaacttttcgcacctaacgcacgctgaataatggattggtttgtacaccaaaagaataaattagaaataatcattcctgtgaataatgttgagaaaggaacaacagaattatcgtcaccaatagaattaaatttatcagggtttgtttcgtaaatggtttttaaaccatgccaagcattaccatctcccacataagctaaacctaaaacagccactaaaattccaccgaccaataacccgataccattaatagtatcagatacagcaaccgctttgagtccaccgaaaattgcatagactgatccgagtattccgattccccataccataatccaaattgccgtagtcttatcaatgttgaagacggtagagacatcaaagagactttctaatgcaagtgcacctgtataaagcacgatcggcaacaatgaaataacatagcaaccgaggaacaataaagaggtgattaacaatgttcctttgtcaaaacgtttttctaaaaattccggaatagttgcaatgccaagttttaaatacttaggtaagaagtaaagtgcaaacattgcaattgtaattgccgctaaaacttcccatgccattacgataaaaccttcacgataagccaaaccgtttagacccactaaatgctcggtagaaaggttagttaataacatagatcctgcaataaacgttgctgtcaacgaccgcccggctaaatagtagccttcagagttgctaagatcgtcttttctggtgtaccaccaagcaagcacagcaacaagggctgtaaatcctataaatgagataagagatagcatagaaattccttatatgaatgagtgtttctatcattgttgtaaacaacacatcgataaggtcgaaaggtgaccttgtttgaaatatatatttcaaaaattattaaatcaaatattttttttcattttgttacagagatcaaactttttagtgaaaaactatcagaaagtaaccaagaaaattttatttttaagacttgtaaactcaatatgacattttggtctatatctcaagaaacaaaaatttaaattaaaaacaccgcactttttacattgcataacaccgttactaacaggtaaactagacaaggttaaactagggatgaatatgaaattactaagtaaatattttgtcagatcaatactgaacacgagcatattttgcatatacctagcaagttcgttttcttttgctgaacatcttgttgatttaaaagttgttggtgtaactggtgtacaaaaaacgactaatgtagacgcttatataaataccattgatgaagaagagcgtgatggatctgaacgttatcgacaattagttcgaaccgcaattgataaagcattacgtgcttatggttattacagtagcacagtgaatttcactttacagccggcgaaatcatctaataaacccgtgcttgttgcaaatgtggacatgggaaggccaagtattattcaacgtgccgatgttactattcttggtgaagcaaaagatgatgaggtttttcaagatttacttcgtcgtactgcccaaaaaggcgaacacgtaagccatcctgtttatgaggactataaaagccggttgcaaaagcaattactcgctcgtgggtattttgatgcaaagtttgaggtttctcgttttgaaatcaaaccatccacttatcaaggttggtggaaaatggttttaaacagtggcactagatacaaattcggacaattcaattttaagcatagtcaaattcgtgaagattacttacgcaatatgatgccaatcaaaacaggcgataaatatttaattaatgatctctcatcacttaccaacgactatacatcatcaaattggtttagatcggttttattagaaccgaaagtcgatgaaaaacgcaaggtggttgatattaatgtattgctttatcctcgcaagaaaaatgcaatagatgtagggattgggtattcgtctgatgtaggcactcgattcaagctcagttggattaagccttggattaataatcgtggacatagtttcaattccaatttatatatatcagccccaaaacaaactcttgaggcgaattataaaattcccttactgaaaaatccgcaaagatattattatgaactgtctggtggttttgaaaaggaaaatactaaagatactcaaactatagcagcaagttttgctgcattacgctactggaatagagtgaccggttggcaacattcttttgggttacgtgtacgttatgactcatttacccaagccaatgtttcagatagaacattatttatttatccaacaatatcggcgaatagaacacgcttaagaggtgagttatttcctacttggggagactcacaacgcatcacggtagattttggaagcaaacgttggaagtctgatgtaaacttctttcgaataaaggcctcaacagtttggatcagaacgtttaaagaaaatcatcgtttcttgacacgtggcgaaataggttggttacacaccaaagatattaataaaataccgcccgcacttcgcttttttgcaggcggggaacgtagtgtgcgtggatacggttacaagaaaatttctccaacatcttctgatggcaaaccaataggtgcaccatatctattaactgttaatactgagtaccaatatcaagtacttgaagattggtggctggcagcctttgctgatacggggttggctgctaataaatttaacgttaaagaactacgttatggtgccggttttggtgtgcgttgggtatcaccggtgggagcaataaaacttgatatagctacaccgattcgagatagagagaagaataaaaatatccaattttatattggattaggttcagaattataaggtcgtaaaaatgacacaaataccaaatgaaaatacaacaacagagcgacaggaaactcgctcggttaagccaaaacgtaaggtattacgctggattttatgcacaataagtgcggtcgttttattacttattttatttttagtaaccgcactggctacaaatagcggacaacgcttgttcattcagcttgctgatcatttcatagataatctgcatattgctcaaattgatggtgggttgcaagacggtttacaattaaaacaaattgcttttcacactcaaggtattaaagctgatattgaacaagcaaatataaaactggacttacattgtctattaagtggcaagatttgctcaaaagatctcactttaaatcagcctaaaattcagattgatactgctcaactgccaaagtcggaaactaaaacgtcacaaccaatacaacaaatcaagctacctgttgaagtggacatcaatggtattgagatcaaccagctggatctcacaatagaccaacagcaagttaaattagcaaaatttcggaccgcacttactttaaacaatgagcaaggtttaactttactgcccacagaaattaatggtttaacgatagttcaccgacatctcacagaaaaaacaacgaagaagaaaaagagtgaaaaaactgtaagatcctctgttgattgggaaaaacttacacaacagttaaatcaaccgttattgcctgatatgcccgaaattgagctaccttttgatctacatattcaaggtattcaaggaaaaaattggctatatcaacaaattggcaattcaaatataccgcaaagtgatttacaccaaattgaaatatcaactatttatttacacgcagacagtatagataattctattcaattacaaacgtttcaacttgaaagtaatttaggtcagctacgaggtgaggggacattgcaactcaagcaagaatttccgatagaactacaagttcaagcaacgctcaatgaacttaaacatgatggaaaattgcttttgcctcacagtaacatcaatcttacattaagtggaaatcttaaaaaacaaacctcacttttcctgcaaactcagggaacgtttgagtcgatattacagggtaaaattgagctttattcacaaaaaacaccgtttgacattgaattaaaagtaataaacggacaatatccctttgagaaaaactctacagaaccattgaaaattcaggacatgttttttactgcaaaaggagatttgctcaattatcaagccacattacaaggcaagctcattggtatgggaatgcctgaaaccgatgtggatttagcactacaaggcggattgacacaatttaccttacaacaacttcaagttaatgcgttaaatatgaaggcgaatgcaaacgccaatgtgagctggagagataaacttaagttgaaaagcaatattgatctaaaaggacataatgttcggctaaataatatgcgaattaacaaaattgatttattggctaacattagtttacaagatatagtgcaaggacaagtcgatcttgatattgatggtttcagtttaaataatattaaattgaacagcactaaattacaaattaagggaacggaacaacaacactatttaatccttaaatcaaaaggcgagccggcttccgccaccttaaatttacaggggaaatttgaccgcactttacaacaatggcaaggtattttaagtcaagtgaatattcattctttaattggcaatttgaccaatagtgaaaatattttgttgtcttatgataataaaaagacaattgcacaagtttctgcccattgctggagatcatcggatattcatctctgttttccacaagagttcattgtaggaaaaaccggagaaattccgtttgattttaaaacaattaatttagcgttagtgaataaattgatctcacaagagattttcaaaggacatttatccggtcaaggaaaattcgcatggtttacggagagttctccttatttgacgctacaacttaaaggcgataatctcaatgtggcaaaaaaattagattatcgtacttttcgtttagctatcccaactttaaatataactacagagttacaaaacaataacttaaccctaaattctaattttaatattcaaaaccgaggagacgttaatatggaattaaaattagctgatttaaccaatcagaaaaggttaagtggtcatttaaaaattagcgatatgaatttaaatatagttaatcagttaatcgctagcagtgagaaagtagatggtcaagtcaatgcaaagttgagttttgcaggtgatttaagtaatcctcttttgaatggtgaatttgctgtgagtcaagttcgagctaagttgaaatcagttccttttggtataacaaatggaaatattacactgagcttttatggtgatcgttcaattctaaaaggaaatattcaaactcacgaaagtcatttaaatgttgaaggtcaagcaaattggcgtaatatcgacgattggcaagcaggtttacatattaatgcagataaatttaaggtagatattccttccatagctaaattacaggtatcgccaaatattgaaattcatgcaacacctaaactattagcgttaagtggtaatgttgatattccatgggcaaggatcgaaattgaacgtttacctgacaatatagttgctcccagtaaggatgaagtgattttagatggtccccaaaaaactaaagtagttaaattgatgaaaggagaaattgagacaactacaaagagtggtatacaaattcactctgacttaaaaatcaagctcggcgatcatgtgcgtttagaggcatatggtctgaaaaccgaattaaatggcttgctttcagtaaaacaagaaaaaggcaaccttggcttatttggacaaattaatttacacaatggtcattatgaatcttttggacaagatcttttaattcgtaaagggattattagcttttccggtttaccttctcaacctatgttaaatatagaagcaatacgaaatccgacatcaatggaaaatacgaatatgacagtaggtgcaaaaatagttggtattgccgatagtcctgaaatcactatattttccgagccaagtacctctcaagatcaagcactctcttaccttcttaccggacgatctttagaaaatagcggaaataatggttccggtggctcacttggtgctgcattattaggaatagggttagctaagagtggaaaattagtcggtggtattggtaaagtatttggtattcaaaatttgaacttggatacttctggtgttggcgacagttcaaaagttgtcgtaagcggtaatattacccctacattacagataaaatatggtattggtttattcgatggattggctgaattgaccctacgttatcgcctattacctaaactttatttacaatccgtttccggtataaaccaagcagtcgatctactttatcaatttgaattttaacgatgaataacgaaaatttattacaaaaagtaaccgcacttgtacaacaccgcggtgaagcgaaagaaattgccgctattgatttaggctccaatagctttcatatggtgattgcccgaattattaacggctctattcaagttttatctcgtttaaaacaaaaagtacaattggcggaagggttagatgaaaataatatgttaagccaagccgctatcaccagaggcgtaaactgtcttgctctttttgccgaacgcttacaaggatttgatcctcaaaatatcaatgtagtcggtacttatacattgcgaagtgcggtcaataagatagaatttttacaacaggcggcagaggttttcccctatccgattaatatcattagtggggaaactgaggcaaaaacgatttattccggtgtttctcatacccaacctgagatcggtcggaaattcgtgattgatattggcggcggttcaacggaaatgattattggcgatgattttatccctttaattgccaatagtcgcaatatgggatgtgtcagttttgccaagaaattttttccatgtggcaaaatatcaagggataactttcaacgagctaaaaaaacggcaaaacaatgtattgaagatcttgccaaaccttatcttgacttaaattgggattgtgttttaggttcttccggtaccatcaaaaccgttcatcaagttattagtaccaactataatcaacatgcaattatcacattatcgcacttaaacaagttgataacacaagtattgaaagctcaccatttcaataaattacatatcaatggacttaatgaagatcgtgtagatgtatttgttcccggacttgctattttgaccgcactttttgaaacctttgctatcaaagaaatgcgttattcagacggagcattgcgtgaggggattatttatagcttggaaaaggatttccaagtcaaaaatattcgccaacgtaccgcacttggtattatgcaacaatttaatgtggatctcgcacaagcggagcgaacctatcaaagcaccttattgctcagtgaacaatatcaacgttggcaagctgttgaattaaaaactgaaatgcaagatattctgttatgggcggcaaggttacatgaagtgggggtcgtgattaaccataaaaatttacaaaaacattccgcttacattctacaaaatatggaattgcccggctttgataaagaacagcaacgcttacttactacaataatccatcaccaatttaatcatttcaaaatgcttgacattggaaaatttgcacgctatccgagggctgatgtaatcgcacttgttcgtttattacgtttggctattttactcaataaatctcgccaagcgacatcgaaaacaaataacattaccctaaaaatcgaccgcactctaaaaaaatggtcattatattttgatgcagaatatcttgagcataaccctttagtcaaaaatgaattgatggaagaacagaaacgcttgtcagaatttaacttagcactggacttttattcttaaaaaacgttatatagtagaacgtgcttgtttcatatcagttattgagtactacgacaagatagactaatcaagcaatgaagacgggcagttttaacatgattagcgatgtgtttaagaatgcaagaaacagtgataaaaatttaaaaataatattattttacttggagagattatgcctaaactacgttcagcgaccagtacacaaggtcgcaatatggcaggtgcacgcgctttatggcgagcaacaggaataaaagaacatgatttcggaaaaccgattattgcggttgtcaattcatttactcaatttgtacccggacatgttcacttaaaagatatggggcaactagttgctactgaaattgaaaaatttggtggggtagcaaaagagtttaatactattgccgttgacgatgggatagcgatgggacatggaggtatgctctattctttaccgagccgagatttgattgctgatagtgttgaatatatggtcaatgctcactgtgccgatgcgatggtgtgtatttctaactgcgacaagatcacaccgggaatgctaatggcagcattgcgtttgaatattccgacggtattcgtttcaggtggtccaatggaagcgggtaaaaccaaattatccgatcaaatcattaaattagacttagtggatgctatgattcaaggtgcaaatccgaatgtttcagatgatgtcagcgaacaaattgagcgttctgcttgtccaacttgtggctcttgttcaggtatgtttaccgccaattcaatgaattgtttaaccgaagcactgggcttgagcttaccgggaaatggctcatgtttggctactcatgccgaccgcaaacaacttttcttagcggcaggaaaacagattgttgaactgtgcaaacgttattatgaacaagatgatacatctgttttacctcgctcaattgccacaaaagaagcctttgataacgctatgagtcttgatatcgctatgggtggttcgaccaataccgttttgcatttattagctgctgcacaggaagcggaagtcaatttcactatggcggatattgatcgcctttctcgggtagtaccgtgcctgagcaaagttgcaccaaatacccaaaagtatcacatggaagatgtgcatcgtgctggcggtattatggcaattttaggtgaattagatcgtgccggcttgttgaatagccaaactcgtacaattttgggtatgagcataggtgaacaaattgcaaaatatgacatcaaactcactcaagataaagccatacataaatttttccgtgcaggaccagcagggattcgcactactcaagctttctcgcaagattgtcgttgggatacggttgatgatgatcgtgaaaatggttgtattcgcagtaaagaatttgcgtacagccaagatggtgggttagctatgttgtcaggcaatattgctttagacggttgtatagtcaaaactgctggagtagatgaaagcattttaaagttcagcggtaaagccattgtatttgaaagtcaagaagatgctgtatcaggcattttggggggtaaagtacaagctggacatgttgtggtgattcggtatgaaggaccaaaaggcggaccgggtatgcaagaaatgctttatccaaccagttatctcaaatctatgggcttaggtaaagcttgtgccttacttacagatggtcgtttctccggtggtacatcgggactgtctatcggacactgctcaccggaggcggcggcaggcggtttaattggtgtagtaaaagatggtgatattattgagattgatattccaaatcgtcgcatcgaattgatggtatccgaagaagaacttgctgagcgtcgagcagagcaagataaacttggctggaaaccagctaatcgccagagagaagtttcctttgctctaaaagtttacggatatttcgcaacatctgcggacaagggtgcagtacgagataaaacgaagatataaaagttaaaagtgcggtgttttttatctaatcgtgccctaaaaccacgtcctttagggggggatataaagcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaaagcagaaatggtagtgaaaatggcactttctgtaatagaaaaagttagtgatgattaataaaaataatcaaaaccaacttttgtctactgtgcttttttagatagcaggataaaatcacacctttttattaactattgaacttcaatactggcactttattttcggtgactgtttcttcttccactataactttctgtaagttttcaatagaagggagatcatacatagtatcaagcaatagggtttcaacaatagatcgcaaacctctggcacctgttttacgagctagtgcttttttcgccattgcaatcaatgcttcttgggtaaattctaattcaatattttctaagctgaataaaacttgatattgcttagttagggcatttttcggctcagttaaaatttttaccaaagcctcctcatccagttcgcttaaaggtgcgataacaggtaaacgaccgataaactccggtattaagccaaatttcattaaatcatcaggttcaacttgcttaaataattcggttaaactgactttctcttcatcaatacgaacatcagcaccaaaaccaatacctttgccaccggtattcgttcttttctcaataattttatctaaaccggcaaaagcaccgccacaaataaataaaatcttagaggtgtccacacgcaacatttcttgttgaggatgctttcgtccgccttgtggaggaatagaagctaccgttccttcaactaattttagtaaagcctgctgcacaccttcgcctgatacatcacgagtaatagaaggattttcagacttacgtgtaatcttatcaatttcatcaatatagataataccttgttgagctttctctatatcataatcacaattttgtaataatttttgcaagacattttcaacatcttcaccaacatatcccgcttcagttaaagttgttgcatctgccattgcaaagggaacattgagcatacgagctaacgtttgtgccaataaagtcttgccactgcctgtcgggccgataagcaaaatattacttttgcccaattcaacctcagaagtatttttttcgctacgtaaacgtttataatgattatacaccgccacagctaatacttttttagcataatcttggcctatgacataatcatctaaatgtgcacgaatttcatgtggtgtcggtaatttaggctcttcctcttgaaattcttcatcaatttcttcgatgtcatccgcattagctaacatgtcatgacataattcaatacactcattacaaatataaccggatgtgcctgcaattaatttatctacttctttttgttccttaccacaaaaagagcaatgtaattctttttcttttgtcatttctttacccaatatctaccgtttaattaacacgtcatcaactaaaccgtacaattttgcctgttctgcagacataaaattatcacgatcagtatcttgttcaatttgttcaatagattgtcctgtatgaaatgctaaacgttcatttaacgtctgcttaatttttaaaatttcttgtgcatgaatttgaatatcagaggcttgtcctctaaagccacctaaaggctgatgaatcatcactcttgcatgaggcaatgccgcccttttacctgctgtgccacccgccaataaaaatgctcccattgaacatgcttgtccaatacaaagagttctcacattaggcttaataaattgcatagtatcataaattgccattccggcagtgactgaaccgccgggagagtttatataaatattaatgtcttttgctggatcttccgcttccaaaaagagaagttgagcaacaatcaagtttgccatacgatcttcaacttctccagtcagaaaaatcacccgctcttttaatagacgtgaataaatatcataagatcgttcgcctcttgatgtttgttctacgaccataggaatgacgctcatatatacctcttctaaaaaatctaaataacaaaagtgcggtcattcttacaaaacgaccgcacttaaaactataaaaagctataaattacgcttgagggttcattacttcatcaaacgaagacgctttctcagttacctgtgctttcgttaatacagcatcaacagcttgttgttctaacacgacattgcgaatgttattcattaactctttgtttttactataatattcaatcacttctgctggttgttcataagctgatgcaatatctgcgatcatcgctttaacacgttcttcatcagcctttaactcattagaagagatgacttcagagaataataaaccaacctgaacacggcgtttagcttgttcttcgaataattcacgtggtaattgtgcagcttgttgagcattaccgccaaaacgttgtgctgcttgattacgtaatacttcaatttcttgctcaactgcggcagtaggtacttcaattggattttgctctaacaaaccgtcaattacctgagttttaatacgagaaaccaaagcatttttcaattcacgttgcatattttttgcaatttcattgcgtaaatccgctacattttttgtattagggccaaattttgccacaaattcatctgttaattcaggtaattgcattacttctacttttttcaaagtaatcgaaaatttagcagctttcccttttagattttcagcatgataagtttcagggaaggttacattaatttcaaattgttcacccgctttatgaccaatgataccctcttcaaaaccaggaatcatccgaccttgccccattgctaaaacaaagtctgttgattttccaccctcaaactcttcgccatcaacagagccaacgaaatcgatagtaacacgatcatcagctttagcaacatcttgagtttcaatccaagttgcttgttgtttacgtaaaatgtcaagcatcttatcaatatcggcgtctgaaatttccacaaccggtttttcaaccttgattttatccagtccttgaagctgaacctctggataaacctcaaaagtcgctgtaaattttaattctttaccagcttcaaattgttctactgtaaattctgggcgaccggctaaattcactttattttcaagcatcacattgaaaaaatgtttttgtaataaatcgcctaatacatcttggcgaacagatgcaccaaaacgtttttcaatcatttgtgccggtactttacctttacggaaaccgtcaatacgtgcattttttgctacacgtttcaattcttcacgcacagcttgctcaacagcttcagaaggaacggtgatatttacacgacgctcaagaccttgagttgtttcaatattaaatgacattatgttacctcaaaaagaatttgtactcggcggaaacacgcaccgaacacgttagtaaattaaatttacattaaaagacgaggaattatagcgatacaaaagcaaacagtcgaggaaatgacaaataaaaatctgcatttgaacattttttagcctaatagataaaatttttttgccaagaaatttttccataattttggttctcctgttgagaaatataaaatttctgatgttcgcatatcacaaaaagttatttttacgatctggatcgtaaaaaaagtgcgatggtattttccatattttctttttgcaacaaaattctcagtacatcattaaccaaataatataaacgcacaatatgataattcctcaatctgaagatatgtctccgatagtgatgtcgctcgatggagatacttatgaaataacaccgcacttatggcaaagaaatcagcaacaatcccaaattctgctacgctattttgccattcctttacaggaaaatgaacaaacgttatggttaggcgttgatagtctaaataatattagtgcctgtgaaacatttgcatttttgtatggaaaaattgtagaaccggttttacttaataaccaattacttaaacagttactacaaaacttatcaccacagcaaaataatatgttcgttgaagagcaacctataaatcaatatgtagccgagcatcgtatagaagtaactgaaaagtctgatgaacccgtgattcaacttttagatcacatttttgaaaatgcgttaaagcaacatgtatcagatattcatattgaaccgcaaatgaattgcttgcaaatacgtttcagaatagacggtattttacaatgccaatcgcctcttccgctttcgctgagtaagcgtattctttcacgtttaaagttactggccaaattggatataagcgaaacacggttacctcaagatggacgatttcattttaaaacaacattttctgacatccttgattttcgtttatcaacccttccgacgaatatgggtgaaaaagccgtgttgcgtttacagcaaaataaacctgtacagttgagttttgcggaactcggcatgacagaaaaccagcaaaaatcattcaaacaggcactatctcaacctcaaggactcattttagtgacaggcccaacagggagtggaaaaagtatctcactttacaccgcacttcaatggctgaatgataagcacaaacatattatgacagcggaagatccgatagaaattgaattgaacggtatcattcaatgtcaaataaatccgcagatcgggttagattttagccggctgttaagaacttttcttcgtcaagatcctgacattattatgttgggtgaaattcgggataacgaaagtgcaataatggcattaagagcagcacaaaccggacatcttgttctctcaactttacatacaaatgatgctccgtcggcagtctcacgcttgcttcaattaggggtaaagcaacatgaaattgacaatagtttattattggtcatcgctcaacgtttggtacgaaaaaaatgcccacatacagaaaatgaaaattgcacttgtcatcagaaatatcaagggcgaattggggtttatcaatttttacaaccgcatctaatagataatcatatttgctaccaaacggattatgctcatttgcgtgaaagtgcaatggaaaaagtgcggttagaaataacagatttagcagaagtggatagagttattggacaaagtaatgaataaaaaacggatcttcatgatccgcttttaacctatttaaactttttcaactttaacttgtttaatcatattatccgccacttctaatacagtaatttttagcccatttatttcacattcagttccctcattaggaatttcttctaaatgttctaaaatcaatccattaaaagtgcgggcatcttcggtatctaaattccaattaaataatttatttaaatcacgtaaattggcagatccttcaataattattgttccgtcagattgctgtgtcacttcttcatcaatagatggggcggttgaagtggtaaattcaccgacaatttcttccaaaatatcttctaacgttacgagtcctttaatatccccatattcgtctacgaccaagccaatacgttctttattgttgcggaaattaagtaattgagtattcaattctgtcccctcagggataaaataagtttcatctaccgcacgaatgagcgtttctttactaaattcatttttatccagcattagacgataagcctcacgaacccgtaatatacccagtacattttcatcaatactgcctttataaagtacaacacgcccgtgagcggcatgattcagctgacgcataatcgctttccaatcatcatcaacatcaataccggctatatcattacgtggcaccataatgtcatcgaccgtaactttctctaagtctaaaatagaaagaagcatttcttggtgtgcagaagggatatattgacccgattgatttactattgcacgtaattcttctgagttaagagaatgtgcttttacttcattttttaaacgaaaaagtttcattagcccgctaataaatagatttataataaaaactaatggactaaaaattttcaatagtatgctaataatatgacttgaaacaaaagcaactttctcaggataaagtgcggcaatagttttaggaaaaatttctgaaaaaattaacattacaaaggtcaataaacctgtcgcaacggcaacgccaacatcaccatatatacgcatacctataatggttgcaattgctgatgcggaaatattaactaagttattgcaaattaaaattagactgaggaaaacatccgttctcttaagcaatttctctgttttttgtgcccctttatgccctttttctgctaaaaatcgcatacgatagcgattaacggaaagcactcccgtttcagaaccggaaaaataagctgagagaataagtaagataattaatgtaataaataaggtactaagggggatactatccaaaatataatcctttcattcatttccatgatgccatagtatttttacttatgacgatgacaccaagacattttataactctaaaataacacgactaccgaaataagcgacagtgagcaagatcatacctgaaattgtataaataatcattctttttcctcgccaatataatttccaatgtccaaataaagctataccgaaaacaaaccaagctaaaaacgaaaaaatagctttgggaatattatgcactgagaagaaatcgactaattgaatgctaccggaaataagtgtcaaagtaagtaatatttgtccgctaaacaaagagcgaaagaaatgtttttcaacggtcattaatggaggaacaaccggcgagaaagttaattttttactttttaagctattatcaatccagcgtaattgaatggcatacaacatagcaataaaacaaacggaatatgcaaataaagataaggcaatatggaataataaacttgtattttgacttaaatgataaacccaaatttcaggtaataatgcttgtaaaattaaattgataatagaaaaacagtaaactataggcaacagaaaccaaagtgtttttactcgagccaaaatggcaacagttgcaatagcagcaatcatggcactcactaacgagcaaatttcaattaacgtgaaattattacctatgaacaaatgaataaataacttatttaatgcaataaaatggctaataattgcgatgagtgcggtgactaaaaaagccattttattcaatttaacttcttgaccgccttgccctaataacattggcatgattaataaaatgctaattaaataaaaaaaagctgaaataaccgcaaaccacataaatttaccttacacaatatataataatagttcttattttaacttatccgcttgataaaatcgctataaatttcttgcaaatgatgaaaatctaccgaatttcagtataattatgacaatagttttttcaagaaaatataggataagaaatgtttgaaaatttatcggatcgcttgtcaaaaaccttgcgtaatattaccggaaaaggtcgtttaactgaagataatattaaagatacattgcgtgaagtcagaatggcgttattagaggctgacgttgccttacctgttgtccgtgaatttattcatcaagtcaaggaacgagcgattggcgaagaagtcaatagaagtcttactcccggacaagaatttctcaaaattgtccaaaccgaattagaaaaagccatgggggtggcaaacgaaaaactcaatttagccactcaaccaccagctgtgattttaatggcaggtttacaaggtgcaggaaaaacaacctccgtcggtaaattggcgaaattcctaaaagagaactacaaaaagaaaataatggtagtttctgttgacgtctatcgtccggcagcgattaaacaattggaaaccttggctcaatctatcggcgttgatttttatccttccaatgtttcacaaaaacctgttgaaattgcacgtactgcattggctgaggcaaaactaaaattctatgatgtcttaattgttgatactgccggtcgtttgcatgtagatgacacaatgatggaagaaattcagcaaattcataccgcacttaatccaattgagaccctatttactgtcgatgctatgacaggtcaagatgcagcgaatacagcaaaagcatttaatgaggcattaccactgacggggatcattttaacgaaagttgacggtgatgctcgtggtggtgcggcactttctattcgtcatattactggaaaaccaattaaattcttaggtgtcggtgaaaaaaccgaggcacttgaaccgttccatccagatcgtattgcttctcgtattttaggtatgggtgatgttctttctttgattgaagatctacaacgttcagtcgatcaagaaaaagcagaaaaaatgacacaaaaattcaagaaaggagatagctttactcttgaagattttcgtgaacaacttatcgaaatgaaaaaaatgggcggaatgatgtctatgttggaaaaaataccaggtgcgagaaatctccctgatcatgtaaaaagtcaagttgatgataaaatgttcaataaaatggaggcaattattaattccatgaccttaaaagagcgtgctaatccggatattattaaaggttcacgccgacgccgaattgcattgggatccggtacacaagtgaaagatgtgaataatctgttgagacagttcaatgaaatgcagcgtatgatgaaaaaaatgcgaaaaggcggtatggcgagaatgatgcgtggcatgcaaggcatgatggggggattaggtggattaggaaatatgtttagacgctaatatccacatatttatagggcgagttggatactcgcctttcttttattcagtttttgttaaatctctaatcttgcgatagaccacgtccaaattcgtactaaaatgaattttatgtatttctttcactgtcttagatttaacaatagttcttaagggttggaactgcatattgcacatatgcaattcttgtgaaggcaacatatgttggataaaacgggtcaaagcatgaattcctccagcatcaagcacagtcactgcatcacattgcaatacaatatgtttgatctctttccctgtatgagtagttttttcatgtaagtcggcaaacaagttatccgctgcggcaaaaaagagcggtccgctaatacgaaaaactacggtatcacacagatcctcaggatgtgcaatttcaaaagatcttgtcatttcagcaatagtacggataaacaatagacttgctaaaagcacgccaacggtaattgcaattaccatgtcaaaaatgacagttaaagttaaacaagtcagcaagactgcaatttcattcaaacctgatcgacggattaattgaacaatttgcccaacgtttgccatattccaagcaaccacaagcaacaacgcagacatagaggcaagcggtaaataagacaatgcttttgcaaaaaataatagagagaataaaactaataaagcatgtatcacactggaaataggtgacaccgcccctgatttcacattagccgcagaacgagcaatagctgctgttgctgtaatccctcctaaaaatggtgcaacgatatttcctaacccttgagccaataattcattattagaatggtgcttagtactagtcatattatccaatatcaccgcacaaagtagagattcaattgcacctaatactgccatagaaaatgccgccggcaataaggcctgcaaggtattgaaatcccaattgatcacttctccatcagcattgggaaaattccaaggcaaaataatttcgggtatgacattcggaataccatatcccgtactaccgtctgataggctataactaaaagaagagcctattgttgccacatcaaagccaaaatgaatcaatgcaatggataataacgtaccgataataacagcgggcagatgaccgggtataggtaaacgaaatttatgccattttgtcagtaaaattagcgttacagttccgactgcagtatcagcccaattaattgttggaagtgcggtaaaaattgcttgcaatttgccaaggtaatgtaccggcattgtggcgacattcaagccaagaaaatctttaatttgcaatgtcgcaatcacaatcccaattccacaagtaaaaccaagcgttacagagagcggaatatattcaatcaaacgacctagacgaaaaaaagccattaaaattaaaataatccctgacaatagagttgccatgagtaacccgcttaacccaaattgctgcgtcacagggtataaaatcaccacaaatgccgctgtagggccggaaatattaaaacgagagccaccggacagagcaatcactatcccagcaacaatagcggtatataagccgtgctgaggcggtacaccgctggcaatagctaatgccatggacaaaggaatagcaataacaccaacagtaagtcctgcaataatgtcctttataagatgcgacttaccatagccaattttaaagctatcttgcagtgcactaaaaggacgaacagcaagaaaaatatttttagttaaaaaccacttcttcaacatataaattccaacagacaagatgatagagagaagtattgtaactgaaatttaagctaataatttgttttagcacaagaaaaataaaaaatacttgactgaattagaagaaatctttatatttgccgccctaacttcaatggtgagatgtccgagtggttgaaggagcacgcctggaaagcgtgtatgtgggaaactgcatcgggggttcgaatccccctctcaccgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagaaacagagattagacgtggtcgccacgttgtttttaacttacacgttcatttggttttcgtgactaaatatcgcggggaagtttttactcaagcaattttgaacgacttacacaccatttttgaagctgtttgtgctgattttgaagcaaaattagtagaatttgatggcgaagacgatcacgttcatttacttgttgaatatccaccgaaagtagctatatcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacaggacttcccattgctgttgtatgaatagtccaatcaagcatatgtttcgccataaacgttggaattgtgcttttaaagcgttccggcaatctttgaccattggtaatagctttttctgccaaattgaatgcttgctcaaaatgaccaatatcaagcaaatacacaaggcaatagccaataacatcattttgatctgctctcccatcattaaaatgctgctctacaaaaggcatccatttaggtaaaaattgggtgcgtttgtattcgtttctgtccgcaaaagcagaaaattgacggatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttttggctgaaatgtttccatttgaaaagatagtaataatcgccgatgtcgttgcgtccgttgcctacaagggttaatggactgcatatccaactgagcttttcattgatgacggcaccagtgtcccgatctaccttgggaacaacatagaataagccgttgagcttgccttcttctcgttcgtcaacataaggctctttgtgggtttcgatgtcgggttcatatcctacgacttgttcagcaaaggctaagtcttcgctgtccgttctgagcttttcaagatagtcgctcacatcttctaaaggttcgcccaataaatccacaaaaacaacgtcatttgctttgctgttttgtgccaggttaagcaaaagtgcggttttttttatgggggaaaattcccccgcttccattatacgcactttcttatggttttccgggataatgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctaagcgttgagccactccccgcaacaggatcgatgacaacatcgccctcgtcggtaaaaatctcaatcagacgctttaatacatcgattggtttttgggttgggtgtaattttgggtatttcttgcggtcgtcccttgtccattccatccagtttttgatcatctttccgttattgcgaaacttcggcaatttctcgcggtaaagaattaaggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctcaccgccatttaactgtaaaataatgtttgtcttgtaaaaaacaattaaaaaatcaataagttaccattccttaattgttcacattgtaaaataatgtttgtcattgtaatcgcttgatgttcccttttatgttccttttttgagagctaaaaaagtaacagcaacgttatttttatgtagagctaaaatctatgtaaacgtttgcttaatgaaagcgggctgcggtaaaataacccgattttatttaaagctaataaggtattcatatgacacagctaagtttgaaaaaaatttattcggggaaagtacgggatctctatgaaattgatgataaacgcatgttaatggttgcaacggatcgtttgtcggcattcgatgtaattttagatgatcctattgatcgtaaaggtgaaattttgacgcagatttctaatttttggttcaagaaattagcccatattatgccaaatcattttaccggtgaaacagtttacgatgttttacctcaagccgaggcagatttggttaaagatcgtgctgttgtttgcaaacgccttactcccatcaaaattgagagtatcgtacgaggctatttaacgggatcaggattgaaagattataaagccactggcacaatctgcggattaaaattgccggaaggtttggttgaggcaagtaaattacctgagccgatttttacaccttcaagtaaagcaaaagtaggtgatcatgatataaacattagctatgcggaatgtgagcaattaattggcgttgagcttgcaaagcaagtacgggaaaaagcgatttcactttataaagaggcagcggaatatgcactgactaaaggtatcattatttgtgatacgaagtttgaatttggtttagatgaaaatggcgtattaaccttaatggacgaagttttaacgccggattcaagtcgtttctggtctgtggaaacttatcaagaaggcactaatccgccgtctttcgacaaacaattcgtgcgtgattggctggaaaagagtggttggaataaacaggctcctgcacctaaagtccccgctgatgttatccaaaaaactgttgataaatataaagaggtattggatttattaacaaaataattggaagtgcggtgaaaatttgttaaatttgaccgcacttttgccatgaaataagtttgagataatatgagagctgtttcaatcgtagggttagggtggttaggtttaacacttgcccgtcatttaaaaaatttgggttggaaagttaaaggcaccaaacgcacacatgaaggcgtggagcaaatgcgtttaattcgattggaagcctatcatctggaactcacacccgatattaatgctgatcccgatgatctaacagcattactttctgtggatgctttagttatcaatattccaccgagtcaatatttttttcatttacaacactacgtacagggcgttaaaaacttagtgaatgaggcattgttaaacggtcttcaacatattatttttatcagctcaacctctgtatttcctgatgtttcaggcgaatttgatgaacaaagtcagattgtaccccagtcagaaatgagtaaagcattgcttgaaattgagcaatggctgtttgagctgaaagatgttgactgcgatattattcgttttgggggacttgtgggcgaggatcgtcatcccgtttattctttagcgggaaaagatgaattatcagcggggaatatgccgatcaatttggtgcatgttgatgattgtgcaagagctattcaattgttattggaaacaccaagttcccagcgtttatatcatttggtcgcaccgcaacatccgactcgagcagaatattactcacagatagcagaaaaattagcactggaagcaccgcactttatttgttcggaacaagatccaagacgtgttattttagcgaataaaatttgccgagagctcagttttgtttatcagtgtccagatccttatttgatgttatttgaaagaaaataaaaaatatccgatttgcatttttaatcaaaaaaatgcaataatatgcagaatttattcaaaaaaaaatctataatgcaaaaaagaaggtcataaatgtcaaatacaattttacaacatcttccaattggtcaaaaagtaggcattgctttttccggtggtttggataccagtgcagcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgctgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggttggatttgaagacggtgttcctgtcacattaaacggtcagtctttttcaagtgcggtcgaactctttttagaagccaatcgcatcggcggtcgtcatggtctaggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagctcgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccgcaattggataaaaaatagtttttttacacgccgacatagttgaccgcacttttaagtgcggttagtttttgctacaattctccgttttaaaacaagcaggttatacaaacgacggattcatctgataatgaaaaatttattttcttttccttctttctatcagttttctaatgaaagacgttttttaaaacggttaagaactcgtattcgctattatttttatcgtttaacttgttttaaagaatgtcagatttttgttacctatttaaatcataatcctctttggattgatatattcacgaaaagttacaatcgttgtgatgctgtgcttagaaagtattgcgataaccgttttaataaaaaacaacgtgtacaagcaattatggataatttttccgtagcagaacaagtatttgggcggtctttctcacaactgttagttgaaaaagataaggttttattggctgaattaacagatgagttggatttgtatttagcaattaatcaaatagatccttttgaggggttttttgcggtaaatattcgcaataaacagggtcaacgtatttacgatgcctctttttcttttttggcagggaataaattattgatcacgtctgtgcaaggacctagtgatgataattcacaagaattaattaaatcgacaacgaagcaattacatggtgtacgcccaatgtttatgttggtaaatgtgtataaattgttagcaaaagagctgaattatgaacttttaggcatagcacataaaaatcaaggaaaatatcgttggaacgacaatgcacgtttgttatttaattatgatgatttttggcaagaaaataatgcacttttaaaccctcagggctattggcaattacctgtagttattgaacgtaagacgctggaagatattcaaagtaaaaagcgttccatgtatcgcaagcgttatgaaatgtttgattttattgaaaaaaatataactgagatttttggaaaagaaaatttgaataaatagaccgctctatttggtattcaagttttaaatggcatataatgagttgctattgatttttagtttgttttattaatttaaaggtatgactgtgacaactgaacgtattgcaagaataattgaatcaaaagaaattatgacacttctccctcatcgctatccgtttttattggtagatcgtgtaactgattatgaagaagggaaatggttaaccgcaattaaaaatgtgagtgtaaatgaaccttgttttacaggtcatttccctgaccaacctattttgccgggggtattaattttagaagcattagcacaagcaatggggattttggcgttcaaaactcacgagttaagtaataaagagctattttattttgccggtgtggatgaggcacgttttaaacgtcctattttaccgggagatcaaatgatgttaaaagttgaagtcattagggaacgccgtggtattaccgcttttacaggtgtggcgagtgtaaatggtgaagtagcttgtgaagccaaattaatgtgtgctcgtagataattaaggagcaaaaatgattcattcgactgcaaaaatccatccttcttctattattgaagaaggtgcaaaaattggtgaaaatgttgttattggtcctttttgtattgtgggaagcgatgtacaaattggtaaaggtaccacgttatattcccatgttgtcgtgaagggagtaactaccataggggaagataaccaaattttccaatttgccagcattggtgaagtcaatcaagatcttaaatatcaaggtgaaccaacgaaaacgattattggtcatcgtaatcgtattcgtgaaagtgtgactattcatcgtgggacagtgcaaggtggtggtgtaactcgtattggtgatgacaacttgttgatgattaatgctcatattgcacatgattgtcaaattggaaatcgttgtattttagccaataatgcgacgttagcaggacatgttgaattaggtgattttgttattgttggcggtatgtcagccattcatcaatttgttattgttggtgcacatgtaatgctaggtggtggttctatggtaagtcaagatgtgccgccttatgtaatggcacaaggcaatcatgcacggcctttcggagtaaatatagaggggctaaaacgtcgtggttttgataagccgacactacatgcaattcgtaatgtgtataaactgatttatcgcagtggcaaaacccttgaggaagtcattcctgaaattgaaaactatgcacaaactgaaagtgcggtaagttttttccttgactttttcaatcgatcaacacgtggcatcattcgttaatgggtagcctaaaataatgttgtaataaaataggaatgaaccgcactttttttaagtgcggttattttttatggtgtttttatgatagataaaaaaaatataacaattggcattgtcgcaggcgaagtatccggtgatattctcggtgcaggtcttattcgagcgttaaaaatacaatatccacaggcacgttttattgggattgccggtaaaaacatgttggctgaggggtgtaaaacgttagttgatatggaagaaattgctgtcatggggttggtagaagtaatcaagtatttgcctcgtttgctgaaaattcgtcgtttagtcattgataccatgttagcagaaaagcctgatatttttattggcattgatgcaccggattttaatttggatatagagttaaaactcaaaaagcaaggcattaagacgcttcattatgtcagcccttctgtttgggcttggcgacaaaagcgtattttcaaaattgctcaggcaacgaatttagttcttgcttttttaccctttgaaaaagcattttatgatcgttttaatgtgccttgtcgctttgttgggcataccatggcagatgccattgatttgcaaccggatcgccaagatgcttgcttccaacttaatctggagccaaaacatcgttatgtggctattttagttggaagtcgagaggcagaggttcaatttttaactcccccttttttacaaacggcacaattaatcaagcagcgttttcccgatgttcaatttttagtgcctttggtaaatgaaaaaagacgtaaacagtttgaacaaattaaagcccaaattgcaccgcatttagaggtcatttttctagatgggcaggcacgccaaacgatgattgttgctgaggctagtttacttgcctctggtacagcgtctttagaatgtatgctatgtaaatcgccaatggtagtgggttataaaatgaaaccttttacttactttcttgcaaaacgtttagtgaaaacgaaatatatttcgttaccgaatttattagcagatgacatgttagtgcctgaaatgattcaagaggattgtactgctgagaaattagctgaaaaattatctgtttatttggagcaaacggaaagtgggattaaaaatcgccaacatttaattcaacaatttactcaattacatcaactgattcgatgcgatgctgataagcaggcggcacaagcagttattgatttattaaatgatgaggtataaatgacaaatgtatttatttatccgaatgtggaattcattgcaggcgttgatgaggttggtcgaggacctttagtgggtgccgtagtgacggcggcggttattttagatccgcataatccaattgaagggctaaaagacagtaaaaaattatcggaaaaaaagcgtttgcttttggctgaagaaattaaacaaaaagcgttagcttggagtttgggacgggcagaaccggcagagattgataagttaaatatcttgcatgccactatgttagcaatgcaaagagcggtagaaaatttgaaaattcaaccgcactttgtattggttgacggtaaccgtattcctcaattgccgatgtcggcacaagcggtgataaaaggcgatagtttggttgctgagataagtgcagcatcaattttagcaaaagttgctcgagaccaagagatgatagaactggatagacgttatcctgagtacgcttttgcacaacataaaggttatccaacaaaattacatttggaaagattagctcaattcggggtattacctgaatatcgtcgtagttttgcaccggtgaaaaaattgttatcaactttattgtcaaaaaatcacgagtacattttcaaaatacaaaaataaatattatgttagaacctgttattgagtataatgagaactcagttttcaaaaggaaataatatggctacgcttttaaaaattggcttagtttcagtctctgatcgagcatcacaaggtgtctatcaagatcaaggtattcctgaactgcttgaatggttaaaatctgctttatgcgatccgttcgaagtggaaagtcgcctaatccccgatgaacaaaccttaattgaaaaaacactttgtgaattagtggatgattgccattgtcatttggttttaactacaggcggtaccggtcctgtaaaacgagatgtaacacctgatgcaactttggctgttgccgatcgtgaaatgccaggattcggtgagcaaatgcgtcaagtgagtttgcattttgtgcctactgcgattttatctcgtcaggttggtgttattcgtagaaatagccttattttaaatttacccgggcaacccaaagcaattaaagaaacgctcgaaggtgttaaagatgaacatggtaacgtcattgtgaaggggattttcagtgcagtaccttattgtttgcaactgattgatgggatttatattgatacagatcccaatgtaattgaaagttttagaccgaagtcggcaagacgtactttatagttgaaaagtgcggtagcttttttattttgtttgaggaagatgatgaaaaaaattgaagcaattattaaaccttttaaattagatgatgtacgtgaaagtttagctgatatcggtattaccggaatgacggtaacggaagtgcgtggttttggtcgtcagaagggacatacagagttataccgtggtgccgaatacatggtagactttttaccaaaagtcaaaatggagattattgtgcctgatgaaattgtcgaacaatgtattgaggcaatcattgaaaccgcacaaaccggtaaaattggtgacggcaaaatttttgtgtatgatgtaaatcgtgtcattcgtattcgtacgagagaggaaaatgaggaagcactttgatgtctgaaagaaattcatcgctaactcaagtgctggttgcttgtgctgcaattatcgttattttaggtggcattaaactcgccagtgagattgttgtgccatttctattatcgttatttattgcgattatttgctcacctgtggtgaattttatgactaaacggaaaatacctcattggcttgcgattactttgctttttgtattaattgtggtgttattttattttttagccagtttaattagtaatactgttcaggagtttactcaatctattcctcaatacaaggtactgttgtcacaacgtttaaatgatttgttagcttttgctcatcattttaatattcctttatttttttctaccgatagtattaatgatgattttgatcctagcattatcatgaaatttgtcagtcgttttttgttgagcttctcgaatgtggtaacaaatatttttgtgttgtttttgatagttgtctttatgcttgctgaagcacctactgtaaagcaaaaatttactaaattaatcgttactgaaaatactgttactcaacaaaattatattgaacgtattctacaaggcgttatcggctatttaggcgtaaaaacgattactagtgtgatgacaggattgtgcatttactttgttttatccgtccttgatattcaatatgctattttatgggctaccttggtcttcttattgaattatattcctaatataggatctatcattgcggcagtccctgttattgtgcaaagttttttattaaatggatttatcacgggtttagttgtcagtattgcatttattttgattaatactgtggttggtaacgttttagaacctaagatgatgggcagaaaattgggactatcaactttaattgtttttctgtcacttttattttggggttggttattaggaacagtaggaatgttgctttcagttcctctaacaatgggattaaaaattgcattagaggcaagtccaaatacaatcaaatatgctgagttattaggtgatgtaagcgatgtgcaaaatgttaaatgacgaaaatttattttttatcagacngtgccgtaaaaccacgtcctttagggcgtagatataaggcacaaatatgatatacttcttactgctaacagaggtcgctttagactctcaatgacggcataatcagggcaggacgtgcccgtagcgtctgtgaagtgaatcgcattggcggtcagcagcagaaacccaccgagagtagcccattgcttgcaatgggagctggtaggaatctccttgctttagctaggggaggacgtcaattgacgcaatatatctacaaaaggcatctttcttttcagatgccttttatcttataaaaacttctctttgtactttactaagtcttttttatgtagtgcaaagacgcctattccgccatttcttaattctaaccattggaaaggcacctctgggaattgttcgattaaatgaaccatactattgccaacttcacaaattagtattccattatcagtaagatagtcagcagaatttgccaaaatttctttagtaatagtcagtccgtcaattccggagcctaaagccatttccggctcatgatgaaattctataggcatatcctgcaaatcttcttcatccacataaggtgggtttgtgataatcaaatcatattgatcgagcggtaaatttttgaataaatctgactgaatagggaatacacgatgggtgaggttatgacgttcgatattgatttcagcaacatttaatgcgtcaatagataaatcaaccgcatcaacttctgcatgggtaaattgttctgcacaagcaatagcaatacagccacttccagtacaaagatctaaaattctgattgggtcttgttggagtaaccctttgaatttattcgtgattaaagcactgattggtgaacgaggaataataacacgttcatctacataaaattctaatccacagaaccatgcactattagttaaataggcgataggtaaacgttgctcaattctagcaataactaattgaatgagtgaatttttctctgaagtcgtgagtgctgaattataaagtttttcgggaaaatctagggggaggtgtaatccggttaaaatgagctgaagactttcatcccaagcattatcataaccatgcccataataaatatctgaacggttaaaaatgctataggtccatctgagaaaatcttgtattgtatgtaggctgttctgaacctgatctgttaaaatgcaatctacaagttcttggttaaactgatttatggtactcatattaattctctcaatcaaataaacggcgtagttataccatagttattcataatgagtaagttaaatttaaaaatagggaaaagtatgttaaatgatgaagatatagaattatttcatcgtgaaattcaaggagcaaaaaagatagaacagaatatttttattgcaccacgtcatcgaaatttaaaaaataaagtggagattcgcaatgttcgagaaaaagaagataccttatttttcttttcagatgaatatgaacctttattagatgaagaaagtgcggtgaaatatttacgtccacatgaagatcgttatttgttaaagcaattacgccgtggtgatttctcgcctgaactttttttggatttacatggtttgacacgtaaagaggcaaaaattgagctggcaagccttattcatgcctgtgaaaaggaacatgtttattgtgcttgcattatgacgggatatggaacttatacattaaaacaacaaatacctcgttggctagtgcaacatccaagagtaagagcgttacatcaggcacccagagaatggggaggcgacgctgcaattttggtattgttggacgtttagattatttgttagcatcaagtttagatgtacgttgattttgccggaaaaccgtataaagtgcgggtaatatttggttaatcagattaagttgttgcaatggaattgcgacttcatttcgattgaactgatcagcatgttcatcactaaattgttttaaagaaaactcaatatttagcaataatttttcaaaattatctcgttctaaagtttcaatatgctcaaggacatgaagtaattttttggcgataggataaaactcccctaaaaacaccgcactttgctgaattttctgcatattttttctatatgcacctaaagcagaaatataactcagtagcgaatagttaattttgaccagttcaaatccttcttgcaaataggcttgatattttttaggttcgctattcatgtttgatagggttgtacttaatgcggttgcatattcatgtgcttgccgtctggcaatacgatattttagcggatcacctttgccgaataatagttggctaatgatatataaaaagtatttagcattagcttttatcgcttgttttatcactttatttagttgtagatatttccaatccggccataaataagaaacagcactccaagcaataaagctacctattaatgtgtcggttaagcgagataatagagcgttatttaaatcaaatcccatgatattaaagctaattaagacttgtagtgtaataaaaaaagtagagtagctataattattgctacggaaaaagaaaaacaatgtactagtgacgacaactaaacctaattgcaattctaaagttggatgtatgtaaggcaatagagaaccgattaccacgccaagaattgtaccaatgatacgttgttttaatcttaacttagtcgccgaataattaggttggcatacgaaaacagcagtaagtaagatccaataacctaattgcaaattaaatatttctactaaactacagctaacaaaaacaatgatagatagacgtattgcatggcgaaaaagttgtgattcaaaggtaaaatgactacaaattgtacgccacatattttttaaaccaatgatctgctctgtatatatttgcgttccttcagatcgttcatttgtattttccgaatattgatccatatggtgtaattgccaattaactgcctgtaaattatcgattaatgttttaatggcaagtcgttgtaattgatttaagtgactgttttgataatgtatttcaaacgactgattaatacctaaaatcgcttgttccaaacgaggattgtacgaataggatttattgtattgcagactatgagcaatttcacgacaagattgtgcttgtagctctaataagcgttggatacgaaaaataagatccgtattttttaattgctctgataattgttgataattaaaatgacttgaattaattcgttcatgaatatcttgtgcagcaaaataatatttaatcatttttgtcgtacggcgatgtttatgttgtccacgaatgcgatgaaataatgctgtacgacaagcgttaaaggcagtaattaaattaccgtttttcatggcaagaatgacacgtttattttctaattgttcaatatcatcaggatcaaaaaaaagtgattttgtgtctaaatattctgataaagcaagaaaagcttttgtcatattttcttgtacagggcgatttggaaacattaaatgaacaaaaaccgtgcataaactataaagtaatgtgccacataaaattaaaatagggttgatataccaagaaacatttggtgtataagttaatgttgtataaagagctacaacgagtgtaccgaaagcaatagtgctataactttgccctatagcaccaaccatggtaaataaaaaggtaagagcggtcattaataacaaatattcaattccatgccctaaggtgagttgtacactaagagaggaaatagaaaaagcaattaatgtataaaatacatatttaagtcgtcctgttaatctattatccaaatcaactagtccgcctgcaataatacctaaaattaatggcatagactgttcggaaatatttagtttccaaatagagaatgtcactatatttactgctaaaaaaacaggaatggagagaatgatttttgtattaatccaaggggtcattttatattttttctaaactttttattattttaaccgctcttttaagtaaccttgatagtctagaatacgaatttcagtttcttgttggaatgcaggagaactaattaaaaaatcagcagtagcaatattcatcgcaacaggaatgttccaaacagttgcaatacgcattaaggctttgacatcaggatcatgaggaaccgcattcattggatcccaaaagaatatcagcaagtcaattttcccttctgcaattaagccacccaactgttgatctcctcccataggaccgctaagtaaatttttgatttctaaattcgtttcttgatgaattaaatttccagttgtccccgttgcataaagaacatgaggttgaagtaaagtgcggttagtttgacaccattgtatcaaatcttgtttgcagtgatcgtgtgcaaccagagcaatttttttgttttttgtcaatttgcgataggtggtttgcataatgatagtccttaataaaaaagtgagcttaggcccacttttgagttaaaaacgggttataaaattatttttggttttttgcccaattgaggaagcgaacttgagtttctttgtcggcttgttggaaccaaaactgtaattgttgctccgcaatattttcaccttgcacgacgacttttcctttttgtgctttagcaaatccgagagcaacagcaggcattgccgttgcaaagttggaaactgaagcaacagaaccggatgcattatattcagataatgtatcaattaggttagcccctggaaggaaaccttcttgcttcagtatttcttgttttgtcgcaattatttttccgctatttgttttgacgatgacagacggtgaatctttaaaatttttaatatctcgttcattttccagtttaggggctgagataactacgtcttcgtttgtgccttgaaatgtaacaacaataggatctgattcatataaagaacgatctgagccatgacgaacaatttctgaaacacgaacgacgacttggtgagtttgcgattcattgatattaaatgatttagtagattttaatagatctttattagctttttgtccatcaatagctaagaaatctatgtttgatgaactggttactataccggcaaaagctgctgtacttgttaatagcattgcacttgcaagtgctgcaaaagaaaatttcataattgctcctatagcctcaggaaatataatataaacttatccgcttttagaaaaagctaaccctgtatgctattccaaattaaataaaatgggaatagaaaaaactcgattatttgatttttttctatttttgtagtgaataagtaaaaaaagaaagcaaatttacttcttagttttttttcatttagtatattcaagaagaaattttgacgctgtggaaaaccgaatcataaatgttcgaatcacgatagactgccattctcaaataaaccaactatatagtccctgattgatcaacccgctttactttttattcattttcgaatagactgcctgaaggtgcaatttctcattgattcgtacgatttcttcatttctgtagggctacatatgaaaaaaatgtcggtattaatttggctttgcggtttttcatcattattgtcggcggtagaacgaccgctcctccaattaaatcgtattgatgcccaacagcaacaacgccaaaaggaacaaattcaacagcaaagtgaacgacttcgttccgatcccgatgtgagaatggaaatttcttcagaaaaacctaccgcacttccctttaatgaatctccttgctatcccattcaacatctttccattgtagattattcctccgataacaagacaaaacctagccaatttcaatgggcactgaataaagccgtcacgcaattaaacctccaattaccgcattgtttcggaactcaaggactagggattttgatgaaacaggtgcaaaataatgtgattgaacgaggctatatcacaactagagtggttgccggcgaacaaaatttaacgcaaggcgtattttctttaacggttattcccggtcaagttcgccatacgattattgccgatgtaagtagcctcccttggtttagtaaactgacagctaaaaccgcattggcatttaaacagggagatttagttaatatccgtgatattgaacaatccttggaaaatctcaaacgtgtgccaactgcagatgccaatatcgacattcttccggctgataacagttcagcattcggtgaaagcgatattaaaatcacctatcaacagcggtttccattccgatttagcttaaatttagatgattcgggttcaacatctacggggaaatggcaaggctctgccaccctttcgtgggataatcttttttctgccaatgatttattctataccactttcacacatagcttaaaacatcacagcgataattcggggcgtcgagcaacgagaaactatggcttctattattctattccttttggttattggacactctctgcttcactgtataaaacggattaccatcaagatgtttttggggcgtttgataatacttacctctatgctgggcgtagtgaaacaaccaatttaaatcttgcatatcgtctttatcgagatgcggtacgtaaaaccacaatttcaggcgggttttggtctcgccactcgaaaaactacattgatgatgctgaaattgatgttcaacgccgccgaatggctggttggcaaatcaaccttagccatattgaatatattaaggcagtaacactgaaactttctctaggatttaaatggggaacaggtgtaggtcgcaccatagcggcaccggaagaatattggagaaacggtacttctcgtcctaaaattattaccgcctcggtagacattaattatcctttctatatggggaagcaacccttggcatttaatacgaattggtccgctcaatggaataaaacccctcttattcaacaagatagattgagcattggtgggcgttatacggtgcgtggatttgacggtgagcttaccttatcgggcgagcgaggttggctatggcgtaatgaactcagttggaatattgcaaataaaggacattgggtttacttagccttagatggcggtagagtgatgggacgtagtgatggaatacgattagggcatcatttaatggggacagttttaggtctgcgtggtagttggacgcatttttattatgatgtatttattggacggccattaagcaagccgagcggttttagaacatcgcataccgtaaccggctttaatatcggcttaaccttttaatttagtgcattaggctcaaacgaggattttcttatgaataaacgtcagtttcgtgtgatttttagcaaaacattgcaacctattgtcgtggtttcagaaccggtaaaaaccgaaggaaaaacaaaaagtgagatgcctcaaatgcaaagtgcggttaattttctacccatttttgccgccttaactccccttgtctttcgtttgttctgtgctttgagttttgtcttttcctcgtctgtatttgcggaaaccttaatcatcaaagccgatcccaacgctcccaaaaatcaacaacctattgtgttgcaaacagcgaacggattaccgcaagtcaatattcaaaccccgaatgataaagggctttctcataataaataccaagattttaatgtagacaaaaaaggggcgattcttaataacagccacaaagacacacaaacacagcaagcaggttgggtacaaagcaatccttatcttgctcgtggcgaagcaaaagtgattctcaacgaggtaacatctacacatccaacccaacttaaaggttatgtggaagtggcaggcagaaaagccgaagtgatcatcgctaatccaaatgggcttcattgtgatgggtgcggtacgattaatgcgacacgctcaacaatgaccacaggcaaaccgcagattattgatggacaagtagaaagcattaacatagaaagaggcaaaataaccatcagtggcaaagggttagataacagtcgtgtcaattataccgatattcttgctcgagaagcggaaatcaatgcaggcgtttgggcggggaaaaagcttaatgtggtaaccggcaaaaacaccatcaaacaggcagatatggaacatggcggaaatgatttacaaattacccatattgacagccaaaatctcagtgaaaacgcaccgcactttgctttagatgtgagtgagcttggcggtatgtatgcggggaaaattcatcttgtcggcacagaacaaggactgggggtgcgtaatgcagggcatattggggcaagtgcggacaatttagtgattgattcacaaggtaaaattgtcaatcaaggaatgatttctgcgaagggaaatctacacgtcagtacgaaaaaagaaattcagaaccaagggcaattactcaccgaagctcagctaagtaccaaaagttctcatttggataaccgtggcggtaagattgaaggaagaaccgcacaaattaatgcgaccgagacagtgaataatgatcgcataggttcaacaggatctttgattcaaaccgctgaaaaacttgatattcacagcaaactcgttacaaacaaaaacacgaaagcgtcacaaagtaagccccctgaacaaggtattattgcaggtgtactgacaataaatggcgatgctcttgccaatcaaaacggggcaatttatggcatgcaaaatgttcaacttaatctttcggtacacttggataatcagcaaggcgaaattctctctcttggtgagttacaaattcaaggcgataaacttaatatgaataatgaacatggggaaatcgcaagcagaagtaatttagctatttatgccaataaattagaatctgaaggagaaattgaaagtagccacaatgcgagtattcacctcaagcaagatttaacgcttaataatgctttcaaagtaggcggtaatttagacttccaaacacagggcaattttatcaacaactcagttcttcgtgtgggagagaaactaagcatacaggctcataatatcaataataacagggagagtgagctatctggtaaaaacacccaaattctcagtaatgaaataattaatcgaggattaattgatggtgaaaaaaccttattaaaaagcaccgcactttctaaccttgggacagggcgaatttatggcaatcatttagccattgcgacaccaaatcttatcaatggaaaagaagacaatgcttcgccaaccatcgcagcacgtgaacgattagatttggcggtcggttcacttatcaatcgtgatcatgcgttaatttttagtgcgggagagatgggcattggcggtcatcttaatgaacagcaccatgctgaggggaaagcttcattcattgataatggcagtgcgactattgaggctttgggaaatgcttatgtgaatacagcacgcctacaaaatcacgacttacacttgcgattgggggaaaatcacaccgatgaacggcgagttgaatatgcaccgaaaaatacgtctcgacgctatgtattgatagataaagatggcaatcacgggcgatttgattcaagaaataatagtaggagcgatagaaattcttatttaaggctgaatgacggcacaaccattgcggctaatagttggatgcattgggattataatcgccacactattacgacaacgattgaaaaacgtgatccggctaaaattttgattggcggtgatcttcatttatcaggcaatgatcttgaaaataatgcgtctactctttctgtaggaaaacgcttattactcggtgatgaggtatttataaaaaatgataaaaatgaaacgttacattccacaaccggtacatcgctcaataatattgatattgcaggaacgataaatgttacggacaaaggacattgggatagcttccataaaaagaaacgtcgctatggaataggggtaaggaaacgttgggcggtttatggtaccggaagaggggatttgaatgacattcacccgacgagccatttcttcttcaataaggtagataatactatcggtcagcctgttgacagcaccaacacgcaaattacagctcaagctgaggcgattgtgccaaaccaaatgaatggcgtaattattaacttaccggaacaaagtctatatcagattaaccccgatgcccctaatggttatttagtggaaaccgatccgcactttactaaccgtaaacaatggcttagctccgactatatgtttaacgcattgcgttacaatcacgaaaatgtgcagaaacgattgggagacgggttttatgaacaacgcttgattaatgaacaaattcatcaactcaccggacgacgctttttagataatcaccaaaccgatgatgagcaatacaaagccttaatggatagcggtatttattatgccaaaaaatttaacctgcacctcggtgtcggcttaacagcggagcaaatggcagagttgactgcggatatggtatggtttgtgaataaagaaattacgctaccgagcggtaaaaagttgacagttctcactccacaagtttatcttgttgcacgaaatcttgatgtaacttcacaaggtgctttaatttcagcgagagaaattatggggcatattaacggaaaacttaccaatacgggaacgattgcggggcaaaatctgaccgcactttctgccaagaatatcaacaaccaagggcttgttttgggggattccgtcaatttacttgcaaagcaaaaattagttaacctcggcggtagaattgaagctcttgattcagtgacattagtcggcaaagaaggtgttgacattgcaagtacaacaactcgccgagcttatcaagatgactttggtaataaatttgaccgcactcatgtagataaccttgccggtattcatgtcaaagataaaaacggtaaattaattgttcacagcccaaaagatgtaactattaaaggtgcagaactcaatagtgcaggcggaatacttgttcaagccaaccatattgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagcaggtagcctaaaaggnnnnnnnnnnnnnnnnnnnnnnnnnnnnnnnnnnnnnnnnggcagtaccctctcttcccttgagggcgatgtgattattggtgcgaaaaaagtcgatattttggctgcagatgacagatacgaaagccattataaacagacgatggaacaaaaaggttttacgattgcggtgaatattccggtggtgcaggcggtacaaaatgcccttgcggtagcgaaacaagccgaacaggttggcgacagtaaaaacaaccgaatcaatgcgatggcagcggcgaataccgcatggagtgcgtatcgagcgggacaagggttaatgcaagcgagtcaaagtctcagccaaatggcgaacggcgatatggcacaaggggcgaatgtcagtgtgtccatcacttatggcgaacaaaagaatgtgcagaccacggatatccaaggcaacacggcggcaaacagtgcgataaatgcgggtggaaaagtcaccgttgctgccaccggagcgggcaaggaatcggatattcacgttgtggggtctgacgtatcaggtcaacaaggcaccctcttacaagcagaagatgaaatcaatttacgggcagccaaacaaacgcaccaagagcggagccaaaataaatccgccggytttaatgcrggtgtrgcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacaggttcatgcccaaaacctcaacattgaaagcctgcaagataccatgacgtataaaggcaaacaaatgaatgtgaaaggacaggtaacggtgggctatggcttttccgcctccgccaacttcaatcaatcgaaaatcaacgccgattatgcaagtgtgcaagaacaatcggggatttatgcaggagatgaggggtatcaaattaacattgcccaacacactgacctcaaaggcggcttaatcacctccaccgcccaagccgaaaaacagggtaaaaaccaattcagcacaggcacactttcttattcggatattcaaaatcacgctgattataatgggagtgcggttggtgtaggagtacaagcagatattaacggtggctgggatggtcgtcaggttagagatggctcaccggtaagtcgagtgaatcaaggtatcggctttggttatgacaaagacagccaatctagcctaacaaaaagcggcattaatacgcaaaacctcatcattcgtgacgaacaaggacagttggcgaagacgggaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatattggtacccttaatacaaaaaataaaacggattacaatgcggatatggataattactaccgcttagaacagcatcaagaagtcggttctcaattaaatggaaaaggtaatatcacccttgccggtgaacagggcgttgtgattcgccaaggggaaattcatagcgagaacggtgatgttcatattgcctcaaacggtaatattcgcattgaagaagggcgtaacaaagagcggctttcttctgcctctaaagtgaagcatagtggttttcttcaatccacgacagatatcactaaacacgagcaccattatgatttagctcaagggtcaacccttgatggtaagaatgtggtgttgcaaagcaatgctaacctgacggttcaaggctcaaatattgttgctgaaaatcagctcaatgctcgagcgaaaaacatcgcaattaaggaagcagaaaaccgtgttttcgaacaagatgttgagaaaaccacgaaatcaggcttaatgggttcagggggatttggctttagcattggcgaaaagaaaaccaccacagaaaccaatcaaaccaaatattacgccacaggtagccaagcaggtagcctaaaagggaacactaccctacttgcccaagagcattatcaccaacaaggcagtaccctctcttcccttgagggcgatgtgattattggtgcgaaaaaagtcgatattttggctgcagatgacagatacgaaagccattataaacagacgatggaacaaaaaggttttacgattgcggtgaatattccggtggtgcaggcggtacaaaatgcccttgcggtagcgaaacaagccgaacaggttggcgacagtaaaaacaaccgaatcaatgcgatggcagcggcgaataccgcatggagtgcgtatcgagcgggacaagggttaatgcaagcgagtcaaagtctcagccaaatggcgarcggyratatggcacaaggggcgaatgtcagtgtgtccatcacttatggcgaacaaaagaatgtgcagaccacggatatccaaggcaacacggcggcaaacagtgcgataaatgcrggtggaaaagtcaccgttaccgccaccggagcaggcaaggaatcggatattcacgttgtgggttcggatgtatcgggtcaacaaggcaccctcttacaagcagaagatgaaatcaatttacgggcagccaaacaaacgcaccaagagcggagccaaaataaatccgccggytttaatgcrggtgtrgcggtgagttacggctcaaatggtttagcctttggatttaccgcagggggaaattatggcaaaggctatggcaacggcgatgaaaccacttggcgaaatagccatataggcgataaacacagccaaacccacatcatgagcggtggagatactgccattaagggagcccaagtgcgaggcaaaggcgtacargttcawgcccaaaacctcaacattgaaagcctgcaagataccatgacgtataaaggcaaacaaatgaatgtgaaaggacaggtaacggtgggctatggcttttccgcctccgccaayttcaatcaatcgaaaatcaacgccgattatgcmagygtrcaagaacaatcggggatttatgcagggaatgaggggtatcaaattaacattgcccaacacactgacctcaaaggcggcttaatcacctcgacagaacaagccgaaaaacagggtaaaaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcgaatcaagccaaattggcgaaaggcttagattctttaacggggacgacctctttcggattcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgaacaaatcgcagcggaagttaaaacgaacatgaccaccgacaatgccgaaagccgttcgggtaagctggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagatactatgacgtataaaggcaaacaaatgaatgtgaaaggacaggtaacggtgggctatggcttttccgcctccgccaacttcaatcaatcgaaaatcaacgccgattatgcaagtgtgcaagaacaatcggggatttatgcaggagatgaggggtatcaaattaacattgcccaacacactgacctcaaaggcggcttaatcacctccaccgcccaagccgaaaaacagggtaaaaaccaattcagcacaggcacactttcttattcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacaggtaacggtgggctatggcttttccgcctccgccaatttcaatcaatcgaaaatcaacgccgattatgccagcgtacaagaacaatcggggatttatgcagggaatgaggggtatcaaattaacattgcccaacacactgacctcaaaggcggcttaatcacctcgacagaaaacgcagagacggaaaaccgcaaccaattcagcacagacacattcacctattcggatattcaaaatcacgctgattataaaggcagcagtatcgggttaagtggttcaatggcaataaactttgacacgccgttaggcaaatacggacaagtgcaaagtaataaacaggcggtgaatgacaaaggggaaaaactttacatagatagccaaggcaagcaaaccaccacaagccgagacagtgcaggtaatgcaaaccaagccaaattggcgaaaggtttagattctttaacggggacgacctctttcggattcggctatgacaaagaaagccaatctagcgtaacaaaaagtgggattaatacgcaaaacctcatcattcgtgacgaacaaggacaggttgaaaaaacgggtaaaaccgttgagcaagtgaaagcggaagttaaaacgaacataaccaccgacaatgccgaaagccgttcgggtaagttggaaaataaatttgataaggaaaaagtcttaaaagaacttaatattcaggtaaaagtaacacaggagttcaggaagaatgcattttcgacgatagatgcttatgtactgccaaaacaggctgaattaagggaaaaaataaaagcagcacaaactgaagaggaaaaagatgaactgtataaggaaatttataaattgcaatatcaaaaacgcttgttagaaacgacagtaggtattattgccggtacacctgagattgctattacacaaggaacgctacaacttgcagcgaccaaaatgcgagaagaaacgctaaaaaattcccgcttatttaaaggaattaaggataaaaagacgggacaaatattgagaaatgacagttacagtagtggttattttgatggcgtgaagttaggtggtgtacgaattgatgttgatgtgatttgtaatagcggaatgggggcttgttctaaaaataatgatggttctataacttttaatggaaccaatgattacacacttaaagatgcaatagatcctacacaaaataataaagcaaaaaaattatatggtgaaacaggtggtttccaagcggtagaggggggatggtattttaatggagaacctatttttaaatataaacttggcagtatttcagatttatctgttgaatcttttgcgggtacacacgatatgtcaggcagtcaaatttggggttggtatgacaaattagggaatacagcccctaaaacaccaatgcaagatacgtcatctaaagcaacaactataattgctattcctatatctgcaccttttgccgtagcagatctcatgtctgctgatttttttgaagttttaatgaaaatcggaggtcaataaaatgaaaaaagctgtcttaatatttattttattcctgttggctggttgctcctatcatgatgggtgcttttattctccacaactggttagctgtgttgataaaggggaagtatttccatccatatctcgctatcagaaaccgtatagtttaggaagaactgatagtaatcaacgttggaaagatgtaatttcttgtggtggtaaatatttggattatgatcaaagaagtgttcctttcgagaaacaagaagaattttattattgtatgctgggtaaaggatatatccatctttcccctgcaaaatgtggttatcaaaaccctaaatgggataaaggggtatgtaatttctaatttaaaatgtagatatattacctctgtcaaagatgaaaaagatttaattatgaataaagagagaactatttatgatttaaatagaaataaaagcagcaaataaaggagaaatagcaatgaaagtatttagtattattagtgttgtctttttgattgggtgctcattcggtggattcaaaccacctaaaccatattatcagtggcgttttgaagataaaaattttgaaacatcttatgaatatgctgtttttagaggcaaagaaatgcgatcttgtggaatggatcctgtattaggtgaaagtgttaaacttaaagtcaatttgtgtatggaaaaaaaaggatggtatctaaaacaaggtccggtgtgtgaggaaaaatatgtatggaatgagccagaatgtattaaatggcgggctaaacacagtaaacctgatgcaaaaccatgggaataataatttacaacagactgaaaggcaattatgttcacctatatcaagaagaataagaaagtattggctgaaatcactgcgtatagaagatatttttaggactaatcaaattttacatcaagaatcaagtaaaaatttgattttaaatggtgcccgagggcggacttgaaccgccacagctcgaaagccgagggattttaaatcccttgtgtctaccgatttcaccactcgggcaagtgtcctgactcggttatgtgatggaggcgtgtcccggagtcgaaccgagctacatggatttgcaatccagtgcataaccgctttgctaacacgccgtagcgtaaattggagcgggaaacgaggctcgaactcgcgaccccaaccttggcaaggttgtgctctaccaactgagctattcccgctttttcgctgcaacacattcgctgtcagtggtgcgcattttacttcgttatgaaaaactgtcaacaattcttttgaaaaaatatgttaattgatgaaaaaaaactcaaaacaggtatttaagaatgcaatttatacagaatgtgtttgtttttagtacatcactatcacttatttcatttatctattttaatgatatagaaaatattctttaatcactggaaactttgtgcaacaatgcaatcctattatgtcgcacaataataaaatatagctaaaagtgcggtcttttttcttagattaattaggtgaagttatgacacaacaatatgctctagatacattactggctcaggccggtaatagaacagatgaaagaaccggtgcggtatctacgccgatttttctttccactgcttatggtcatcatggaattggtgaaagtacgggatttgattatacccgcactaaaaatccaacgagaacggtattagaagaaacaattgcaaaattagaaggtggagatcgtggatttgcctgttcttcaggaatggcggctattcaattattgatgaacttatttgcgtcacctgatgaatggattgtttccagcgatgtttatggcggaacttatcgcctattggattttgcacataagaatattcatggtgtcaaacctgtttatgtcaatacagcttcaagtgaagaaattgaaaaggcaatcactgagaatacaaaggcgatttttgttgaaacaccatcgaatccgttaatggaagaatgtgatgtggcagaaattgcgaaaatagctaaaaaatacaatttgctattgattgtagacaatacttttttaactcctgttttatttagaccaatggaacatggtgcagatattgttattcatagtggaacaaaatatattgctggtcataacgacacattagtagggttaattgttgccaaagggcaagagatctgtgaccgcttatattatattcaaaatggtgcaggtcccgtattatcaccttttgattcttggttgaccattcgaggcatgaagacacttgcattgcgaatggaacgtcatcagaaaaatgcacaggaattggcaaactttttaagagaacagccacaagtaaaagatgtgttatatccaaataaaggagggatgctatcttttcgtcttcaaaatgaaaattgggtaaatccttttcttaaagcaatgaagttaattacttttgctgagagtttaggcggtacggaaagtttcattacgtatccggcgacacaaacgcatatggatattcctgaggttgaacgtgttgctcgaggtgtatgcaatcgtttactacggttttctgtaggattggagaatgtagaagatattaaagcggatttattgcaggcattttctcaactaaagtaaccgcactttaatagatcaagatttaataaaagtcgcaacttatcatacgtaagtaatttgtcgtggtttatgttgtgatttttcacttgaaaagcggagatttatctttatactctctaactggaaataataaatcccaaacaataaaaggaagaaaaataaaaatgagtgaagtattacatacaacagatgcgacttttgatactgatgtattaaaatcagatattccagtattattagatttttgggctccttggtgtggtccttgccgtatgattggacctattctagaggaactttcagctgaattaggtgataaggtaaaaattgttaaaattaatattgatgaaaatcaagcgacaccggctcaatttggtgtgcgtagcattccaacattaatattcttcaaagaaggtaaggctgtcgcaactcaggttggtgcattaccaaaaaatcaattagtaaattttatcaaccaaaatagctaatatgtagcttaagcaagacgaactaaaatagcttaaatctcaaaaggatttaagctattttgtctattacacctttaaatcgtatataaaatcataaaacattacctttggtaacggttaaagatttaatatttctttcacaaaaggaatagtcaacttacgttgtgcttgtaatgaggctttatctaataaagttaatgtatcaaataaagatttaatatcacgatctaaacgttttaataaaaaattagctgtatcatcaggtaattcgatccctcgttgatgggcattgcgttttatcacttctactttttgttgttcatttagtggatttagctgataaatttctccccaacttaatcgtgaggcaagatcgggtaaagagatatttaaattcactggagattgattggcacttattaacagtaatgtactcccgctctcttttattctattcattaaatcaaaaatagccaattcccattcatgatttcctattattgcatggaaatcatctaaacaaaccaactcttgctgttctaaattttccaaaacttcaggggaaaaatattgtgctttactcaatggaatataaatcgcattgcgttgcgatgctaaaaaataattggaacacgctttaagcaaatgagttttacctgtactttttcctccaaaaatgtaaaagaaaggttgatataattgaataaaatttttacgtaatgaaccgagtaacaataaattattgtcgctacaaaaattctctaaggtatcatcgtctatttgatgaataggcaaagggagttgttggctcaaaaaataattccatttgatagtaaagttgactcataatacagaaaaaataggaacaggtgaacctattcctattaatcttgtaaattttagtcttctatttgatttttagccgatggtaaaatgagatttagaataatagcgacaacggcacataaactaatccctttcaaggataattctcctaaattgacaaacattccaccaattccaaaagtcataaccacagaaataatacataaattacgtgcttccgtcacatcaactttcccacgaattaatgtactcatcccaacgacggcaatagagccaaaaaccagcatcataattccgcccataacgaaggtggggatcgtagataggaatgctccaactttgccgcaaaatgaaattgcaattgcccatactgctgcccaagtcataatagtcggattaaaatttcgggttagcattactgcacctgttacttctgcataagtggtatttggtggtccgcctaatagtgatgcggcagatgttgcaagaccatcacctaataaagtgcggtgtaaccccggattttttaagaaatctttgccggttacagaactgatagccatgataccgccaacatgttcaactgccggtgcaatcgctattggtagcaaatataagatggcttccagtttaaattccggtgtcgttaaattcggtaaggaaaaccaagatgctttggcaataggactaaaatcgattaatcccataaataaactcaagatataacccaccgcaatgccaaacattatcggtattaatttcatcatacctttggcaaaaacagctacaattaaagtagtcaatagcgtaatcattgacacgagaaccgcatcaccatattcatagttactgcctttgccggtcgccatatctacagccacaggtgccagtcctaatccgataatgataataacgggtccaacaacaaccggaggaaaaattttctgtaaagcccccgctccacgtaatttaaccaacaggcttaaggcaacataaacaagtcctgcacaagcaagaccgcccattgttgccggaattccccatgaggctacaccatattggattggtgcaataaaagcaaaagaagaggctaaaaagatcggcactttcttgccggtacatagttggaaaagcaatgtaccaattccggcggttaataaggcagtatttgcgtccaatcctgtgattaatggaactaataccaatgcaccgaatgcaacgaataacatttgcaagccaataaaagcttgtttgattttgcccgaaatttctacggggatattttgatttgtcatttaagtttcaactctctgtctgaattaactaaaagtgcggtctattttccaatagattacgcggaaaaaagcggcattaattgccgcttggtattttggtcttatttcgtaccaaaaatcttatcacctgcatcacccaaccctgggataatgtagccatgctcatttaaatggctatcaattgatgcagtatataattcaacatcaggatgtacagcctctaaagctttgatcccttcaggtgcagcaactaagactaggactttaatatgctgacaaccttttgcttttaataaattaatagtcgcaatcatagaacccccagtggctaacataggatcaacaacaattgctaagcgttcatctaaatcacttgctaatttttgaaaataaggaactggttctagagtttcttcatcacgatacatacccactacactgatgcgggcacttggaacatgttccaatacgccgtccatcatgcctaatccggcacgaagaataggaacgacagtgacttttttacccttaattcgatcaatttcaacagcaccacaccaaccatcaattatcactttttcagtttctaaatctgatgtggcttcataagtcaacaggcttcccacttcagtggctaattcacggaaatcttttgtagtaatatccgcaactcgcatcaaacctagtttatgttttactagtggatgtttaacttcaacaattttcatcgcatgtttccttattgatcgattatgtaaaaaaaatccaaacggcggaattctaaatgatcttgattaaaattaatagtattgaaagaatgttttaataaaaaactgcaatatgcagctgcagaatatttattttaccttaggcaaactgttgcatgcctagcgtgccgtcatcaatgatttcagatgctatgcctaagatttctgctactttatcaccttctttaaacatcacaaaaccgccagattccattttattccaatgttcatctttggtaagtgggaacgttgtaataattgttactttatctgtttcttttgcatagtcacgaaaatcaataatattatcatcgtctatgcgttgtgcttttccgaaaggtgccttacgagtgagatagtgtaaatttgttgaacagtgggccatcatccactcaccattagataggataaaattaaatgtgcctctctgtgttaattcttgtgtgagtttttgaattgcactaaacatatcttgttcattaggctttttgggaaaacgtttctttagttggctaagcatataacaaaatgctgtttcggaatccgtcgagcctatcggttgaaaaagactttctgtcatatcgggtaatgaatttaagttgccattatgagcaaaaacccaattttctccccaaagttcacgaataaaagggtgagtattttcaatattgacttctccttgtgttgctttacgaatatgtgcaacaacatttaaagattttatgttgtattgtttaatacaatcagcaatgggagaagaatgtccgggacgattgtcgcgaaaaacacgaattccttttccctcaaaaaaggcaattccgaaaccatcggaatgacaattagttaatcctgctcttcgacgaaatccctcaaacgaaaaaacaatatctgttggggtattacaattcattcctaaaagttgacacataatttatttcatttaacccaattttatgtctttttatctacacaatgagtatgaatttaacaaaaatacagattaaaaatcaacatggatcttagatcaattagttacataaaatagctaaaaaaacttaccgcaccaagttttcacaaggtgcggtaagcaaataagaaggtttaatataaaatgataaggattagtaaacaccttgtgctaacattgcatcagctactttaacaaagcctgcaacgtttgcacctacaacatagttaatatttttttgcccttcgacagtaccgtattttttacaatttgcatgaatatccaacataatacggtgtaatttttcgtcaacttcctcagctgtccagtataaacgttgtgagctttgtgccatttccaaaccggaagttgcaacgccaccggcatttgccgccttaccaggtccaaataaaacgcctgcttccaagaatgcgtcggtagcttcaattgttgttggcatattggcaccttctgcaacaagttgaaccccgttggcgatcaattgttgtgcatcggataattccaattcattttgggttgcacaaggtagtgcaatatccgctttcactccccaaggacgagctccctccacgtattgcaaaccaaattgttcagcgtaatctttaacacgaccacgttttacatttttaatatctaaaagtgcggtcaatttttcttgtgtaaagccttcaggatcataaacatagccggagctatcagaacaagtgacaacttttgcccctaactgcaaggctttttcgatagcatattgagcaacgttacctgaaccggaaaccactactgttttccctgcgaaagattgtcctttttcagcaagcatagcttgagcaaaataaaccaaaccataacctgttgcttccggacgaattaaactgccaccaaatgacaaacctcgaccggtaaacacgcaagctgcttggttagataattttttcatatatcctgcaagataacctacttctcgtccacctacaccgatatcacctgccggtacatcggtatctgcaccgacatgacgatataattcagccattaatgcttgacaaaaacgcatgacttccgcatctgacttacccttaggatcaaaatcggaaccacctttacctccccccatcggtaaggtagttaaagcatttttgaaaatttgctcaaagcctaaaaattttaaaatagataaatttacagatggatgaaaacgcattccacctttaaacggtccaatcgcactattgaattgaactcggaatgctcggtttacttgcacttgacctttatcatctgtccaagcgacacgaaattgaaatgcacgttccggctcaactaaacgctccaataaagcttcagagcgatattttggatttttctctaaaaatggccaaatggaagtgaatacttcacgtactgcttgcaaaaattctggttgatgaccgtcacgttgttctacttttgctaaaaaatcttctaacgatacgattgctgacataatttgtttccttcttaattgaaatgttttgtttgcttatttatatagagagcctttatcagcccacgattaatatgcaataaaatatcaaaacattgcaactaaaattattaaaaaaaattaaaaaactatttaaatattaaattttatttaaaataattgtatatattttaaatttattttgattttggttgggttgatagaagtaatatcaaaaagcaggaggaaaaaactaccgcacttatatattctaaattgaagaatttacagcaaaataaaaactggagactatgtttatctttatatgttaagtaaaaaatgtaaatattagtttcattttgaagaaatttattacacactatatgggcaaattattttgcaactatttttactttaggagttattatgaaaaaagcactattaacagcattagtattaggcacgagtttaactgttactggttgttttgataaagacaacaacgtttctcagcaagcagaaagtacaaaagaaagtgtatcaacagcaattgctgaaacaaaagaagctatgtcaaaaaaagtgacggaagttaaagagatggcgactgaaaaagttgaagtagctaaagaagctatgtcagaacaagtaacggaagttaaagagatggcgactgaaaaagtggaagcagctaaagaagctatgtcagaacaagtaacggaagttaaagagatggcgactgaaaaagttgaagcagctaaagaagctatgtcagaacaagtaacggaagttaaagagatggcgactgaaaaagtggaagcagctaaagaagctatgtcagaacaagtaacggaagttaaagagatggcgactgaaaaagtggaagcggctaaagaagctatgtcagaacaagtaacggaagttaaagagatggcggctgaaaaagttgaagcagctaaagaagctatgtcagaaaaagtaatggaagttaaagagatggcgactgagataaaaagtgcagtagaaaaatagtctatattgggttagattttctttaatgattagagctagaatgattgttttctagccttttttctttataaattgagattaagtttgtctttttatccaaatttgttagaatcagtcagaattttggggctgattttggattcgacggaattagcgaagcccaaggtgcacgtcgaggtgcggtaggcctcgtaaataaaccgcaaaacaatagtcgcaaacgacgaacaatacgctttagcagcttaataacctgctcatagccttcactccctagctttcgctcgtaagacggggataaagtggagtcaaatccaaacgagatcgtgttgaagccgccgctttaggatcgaagcattaaattgaataaagctagttttttgatggcgtgtctgtccgcagtcaatttacgaaattaaagattagactaaacgtgtaggactgaaggtagagtaatttcggacgggggttcaactccccccagctccaccatatcattcgaaaagaaaatttctagacattttgaaccgcattgaaaatgccaattttggcgtaactttttgtttttaatctttttagtgaaatttgttaacaacttaattttattaacaaaatttatttggcttttagaaggtttacggcacatcttgttaagatgttaaagaaaaaccgaaagaaaaacatttactaattgatggctaagggttgttctgaaaaactaagtttggcgatgttaaaatttgactaattaactctattagaagctagttatatcataactagcttctcgtttttatctccaaattaaattactttttcttgtaattgtagtttggaatagcggtccagcgttttttgaattctttaacgacttgttttggttgacgattgcgtgagaaaagccctttatggtttccttgtatacggtaaatcataaggtttgtttcaaagtctgcaaaattccatacttgttccccaacaagattagggatgctgtcaaaaacactatggctcatagcataaaaatcacattgaaactcttcggtataaggaatatcccacatagaatgtaagccaggtaaagtatctgcaccatattctgtcataagaattggtttatctgggaatttactttgccattttaacaactcttgacgaagtccagcttctcctttagctaaatcaccatgatctacataccaagcatagtatcgattcaaagaaatgacatctaccaaatccattacttcatcacgctctggcgttgccagtaaaatattgactaaggtaacaggacgtttttgcggatccaattccttataaagagcaactaatggtttgaaataatcatgagcacctgcttcatggctggctggttcatttgctactacccacatgacaactgaagggtgatttttatcacgttttaccaattcttgaatcgcttgttcatgtgcttctcgggttttcatagcagaccaagttccattatctttgggatttaaatcaagagaagcggtaaagttttggaaaagtccaacggctggaatttcatcaattaccaaaactcccatgcgatctgcaagacgcatcatttcttcagaataaggatagtgtgaggttcggaaagagttggcaccaatttctttcaaaaggttcatatccatcaagtttgctgcttcgtttaaacctcgaccattgataaaggtatcttcatgttttccaaaacctttaaaataaacaggtttttgattgacaaagaattgaccatctgccacatgaacactacgtacaccaaatggctcatcataggtatcaacaactttaccatcaacaagtagctcaatatgtgcggtataaagataagcatttaaaacttcccataagcgtacttgttcgagagtgatatgcccgttacttgattgtgcaactacttgacgatcttcatcaagaatagttacttggattgtgtcaactgcctttgatgtttcaacagcaatagaaagttttgccgtctttaagtcatctgaaagctcactgacgatggtaacatctgaaatgtgaattttaggacgtaccattaattttactgggcgatgaattcctgcatagttgaagaagtcaaagttttctttaaccacttttttaatactgccatcttcttgagtctcttcaatgtaattaccaacaggaagtgtggtgtaatctaagatattattggcacagacagagatttttatttgattttcttggtaaagatcctctggaataattacctcaaacggagtgaatccacctttatgagaagcaagttctcgaccgttaacataaattttggcattgtgagttaccgaaccaaagcgtaaaactaactcatcattttccgctaatttgggaatatccacccaacgctcataccaaaaatctccaatataattacgcttatctttgtcaaccaccacgtcattaaaggaagttggtactaccatcacttcttctggtgataaatccttttcgggattatgctctcctagtttaaattgccataaaccactaaggtcatataaacttcttgtttttgttaacgttggatataacatatattttctcctttgtgtttcttaacgtttaatctcgtgggaagtctcatctagcaattgatcaatatctgcttgagaaatcacattaatatcgccttcaatggtgtgtttgaacttgaaacttgccatagcaatggccaaacttttttcaggactttcttttttaagcatgccatgaataattcccgctgtaaaagcgtctccagtaccaacacggtctaacacttgaatgcctgatttgtctgtctgataaagatgaccatcctgatataaatagcctttcaatagatattcattagtatgtcccatttctctttgagtaaaagcaaagcttttcacgctataagttttagctaatttatccaaaatgctttttaataattcttgatcttcgtaaggtcttgttaaacctaattggtcttttaaatctccttgcccatcaccggaaagacttaacggctcaattccaatgcaaacatctgctagagcggcaagaggggacaataattctcttgcctcttggaaagagttccataaacttgctctaaaatttaaatcaaaagagacagtgagtccctctgctttagccttggtcatcaaataatgggttaagctataaaggttatcattcaacgctggagtgatgccagacacatgaaaccagtcagctcctttgaatacagactctaggtcataatcactcagttgagattcccaaaaagcagagtgttttcggtcataagttacccgactggcacgtaaggaaaagcctttctggtaataataaattcctagacgttgccctttttccaaaatgtaatcctgattgatttgacgagaaaaaagaaagtttttcgtcatcctacctaaatcattatccggaatggcagatataagagaaacgttgtgtcctaattgtgccaaggttgaaagaacatttaattctgaaccgccaaattgacattctagactggtggtcagtgttagggtttgatactgtggtggtgataaccgtaacaagatttcacctaaagaaactactgttttcaactaaaacctccatcttgatgggttgtgctaaaagtagtatacacgatattatgttttttagtacaagaaaatgggctacagtaaaaaataagttatatcatcatcgtaacagactgcttatttagaattcttaatatctattagattattagattgttattcgcattgatttgtcgataatcttcaatgcagtgatgttttaaaaaaacaagcatattctctttataagatgtttagaaaaatcttttttgttttttgtcgtgtggagtgacaaaagtgcggtgtcttttggtgtgtccttagaaatactttacaagtgttgattaaataagttcaaagatagccagcaaaagaattattttagaaatgcagtaaaaattatcatttataccatagaaatattaacagaaattagtaatttaaattgagattaacgacagaaaatagtaaagtagcccactattcattcacttacaaaaatagcttttaaggcggaatttatgggaaaaagtgttgttgttttaggtgctcaatggggcgatgaagggaaaggcaaaatcgttgatttattaacagatcgagttaagtatgtggttcgctatcaaggtgggcataatgcggggcatacattgattattaatggtgaaaaaacagttcttagattaattccatcaggtatattacgtgaaaacgtaacctgtctgattggaaatggggttgttctttcaccgacagccttaatgcaagaaatgggggaattagaaagtcgagggattaatgttcgtgaacgtttgttaatttctgaggcttgtccgttaattcttccttaccatgttgcgatggataaggctcgtgagtcagctttaggcaacaaagcaattggtactacaggtcgaggtattggtcctgcttatgaagataaagttgctcgtagaggtttacgtgtcggcgatttatttgataaagaattatttgccgagaaattaaaaaatattctagattactataattttcaattggttcattattacaaagccgaagctgttgattatcaaaagacgttggatgaagtatttgcagtggcagatattattacggctatggttgcagatgtttcgacaattttagatattgctcgtaaaaaaggcgataacattttgtttgaaggggctcaaggcacaatgctggatattgaccaaggcacatatccttatgtaaccagttctaacacaactgctggtggtgtatccactggagcaggttttggtcctcgtcatattgattatgttttaggtattattaaagcctattgtactcgtgttggtgggggaccattcacaacagaattatttgatgaagtgggggcggaaattgcacggaaaggaaatgaatttggtgccgtaaccggtcgtccacgtcgttgcggttggtttgatgctgttgctattaagcgagcaatccaaacgaattctatttccggtttttgtatgaccaagctggacgtattagatggatttcgtgaagtcaaaatttgtgttggctacaaaatgcctaatggtgaaattgctgaatatgcaccgttagcagcaaaagattgggaaggtgtagagccgatttatgaaaccttaccgggttggcaagaaaatacatttggtataacagatgttaatcagttaccggaaaatactcgtaattacattaaacgtattgaggaagttacgggcgtacctatcgcgattctttcgacaggtcctgatcgtgttgaaactatgattttaaacgatccttttgcggtgtaaatcataaataatagagacaaaagtggtttaattcagaaatgaattaagccacttttttatctcaatcaacttcctgaaatcttcattttttccaacaaaatcgaacctgtttgaatattcgatctatattcaatatcgttaccaaccgcaataatatttgcaaacatgtcttttaattgcccggcaatagtgatctccgatacaggatattgaatttcaccattttcaatccaaaatccaaaagctccacgtgaataatcaccggtaataatattaaccccttgccccattaaatcggtaactaataaacctgttcccatttcttgtaaaagtgcggttaaattttgtgaatttggcttaaccagccagttatgaattccacctgcatgtcctgtactttgcatacctaattttcgaccgctataacttgtcagcaaataggtttgtaaaataccttgttcgataatttctaaatttttcgtacgaacaccttcactatcaaaaggtgttgaagcaagtttgccaatcaaatgggggcgttcgctaatatggaaccaatcaggtaatatttttttacccaaatgatcaagtaaaaaactcgagttacgatataaacttccaccgctaatcgctgttgccaaatgtcctatcaggccggttgccacactattcatgaaaataaccggtgcttcttgagttggaatttttctcggttgtaaatgagatagtgcttttttggcagaattttcgccaacccacaccgcactttccaactcttgaatattacgtgcaacagtatattcataatctcgctcaagttgttcgttgctgcttgcaatcacagaacaagataaagaataacgacttgataaatagctttgtaacatgccatggctattaccataaactcgcacaccggtatgcgaattaaatgttgcaccttcactatttacaatgcgtttatcataatctaaagcggctttctctgtttgcaaagccaatgaaacggcatgatcaacatcaatatcaaactcatgataaagtgctaaatcaggggcatcaaatgccattaattccttatcagctaaacctgcacaagcatccggagaagtatatttcgcaatagctaaggcggaatctaccgcattttttattgctgcatgacttaaatccgaagttgaggcatttcctttttggttccccaaataaacagaaatacctaaagcaccatcattattaaattctacattctcaatttcttgtaaacgggttgaaacggataagccactgactttagtgactgcaacttctgctgttgctcctgcttgagtggcaatctcaattgcatagcttacagcctcttgtaatatttgctcttgttgctttaatagtgcggtagagttttgtttagttgtcatcataaacctttttattaagaaaaaattttggctattctagcctattttcaaatttgtcgctaaccacaaataccatgtcatttcggcaaaatatgaagttatgctaaactacgccaaattctacataaggaaaataggaacaaattatggcgaaacgcaaaaaagaagtgtttacttgggaagatgaagaacaagaagaaattatttgggtgagcaaaagtgaaataaaacgtgatgcggaagcattgaaaaaattaggtgaaaaacttgtcaacttgactaaaacaaatttggataaaataccattagacacagggttacgtgatgcggtcgaacttgcacaacgtttgcaaaaagaggctcgtcgccgtcaaattcaatatatcggcaaactattgcgagctattgatccggaaccaatccaagaagcgttagataaaatcgaaaataaacatcagcaacaacaagtaaaattacacaaattggaattattgcgtgatgaattggtaacaaaaggcaacaatgcacttacggaattattaatacagtatcctcatgcagatcgccaatatttacatagtctggttcgttcggcacaaaaagagcgggaacaaaacaaaccgcctaaatcatatcgagaaattttccaatatttgaaagagctgattttggaagattaacatgaaaatccgcatgttaaagtgcattaacgtttatctgctatttttcacatgtaccaaaatccgctataatggcggacatttttgatataacgtacctaataatgtaaaaaaaccaaagaggtttattatgactactccagtagttgctttagtcggtcgcccaaacgtaggtaaatcgactttatttaatcgtctaacacgtactcgtgatgctttagtggctgattttcccggtcttactcgggatcgaaaatatggtcaagcacatttcaatggttatgactttattgtgattgatacgggaggtattgatgggacggaagaaggcgtagaggaaaaaatggcggagcaatccttacttgccattgaagaagccgatattgttttatttcttgtagatgctcgtgccggcttaacttctgcggatgttggtattgctcaatatttgcgtaaacgccaaaataaaactactgtacttgtggcaaataaaaccgatggtattgatgcagattctcattgtgcagagttttatcaactgggcttgggtgaaattgaaaaaattgcagcatcacaaggacgcggtataagtgcattaatggaaaaagttttgccgtctgttgccgacaagctaagtttagctaacgcagaagatcattcagaaagtgcggtagaaaattcagatgaaagtgcggaagaatgggaaaaagattttaattttaatagcgaagaagatatacagctacttgatgaggctcttgtagaagaacaagaagaaagcgaagataaaaatatcaaaattgccattgtgggtcgtccaaatgtaggaaaatcaacactaactaaccgcattttaggtgaagatcgtgtagtggtgtatgacttaccggggaccactcgagacagcatttatattccgatggagcgagatggtcagcaatacactctcattgatacggccggtgtacgcaaacgtggtaaagttcatttaacagtggaaaaattctcagtcatcaaaacattacaagcgattcaagatgcgaatgttattttgttgacgattgatgctcgtcaaggcatatccgatcaggatttatcattattaggttttattttaaataccggtcgttctttagttattgttgtcaataaatgggacggcttagatcaagatataaaagatcaagtcaagtctgaattggatcgtcgtttagactttattgattttgcacgtgttcattttatttctgctctacatggtagtggtgtaggcaatttatttgacagtataaaagaggcttatgcttgtgctacaaaaaaaatgacaacatcattactaacccgcattctacaaatggcaacagatgaacatcaaccgccaatgataggtggacgcagaattaaactaaaatatgcacatccaggcgggtataatccaccaattattgttgtacacggcaatcaaatcgaaggtttgccggacagctacaaacgatatttatctaactattaccgtcgtagcttaaaaattattgggtcaccgattcgtttattgttccaagaaggaaacaacccgttcgcagggcgtcgtaataaactgacaccaaatcagttgcgtaaacgtaaacgtttgatgaaatttatcaaaaaatcaaaacagcgataaatataatataaatgggcggaaaatatccgcccaaaatcactgcactttgcctctatattttttcttattttgcgatctctctcgcaaatatttcccaattcaataaactttcaactttttatcttttatattaaagcctttccacacaaacggatataaggataattatgcgagtattagcactattttttatgttgttcattataaaagttcaagcaacattgccggatttcatgctgttggaaaactataaaaatcaggacgtaagcggttgggtgatgagtgaaaagttggatggcattaggggatattgggatggcaaacaacttttcactcgacaaaataaagtcattcagccaccgcactattttattcgtgatttccctccctttgctattgacggcgaactttttaccgaacgtaatcaattcgaaaaaatatcctctattgtacgttccaaaaaagataaaggttgggaaaaaatgaaattatatgtttttgatgttcccaatgcacaaggaaatttatttgaaagactggctgttttacaagattatcttgataaacatcctacaccttatattcaaattattgagcaaattcccattaaaactaaacaacaagtgaaaaattttttacaacaaattgaaaaacagcaaggtgagggagttgttttacgtaatcctcatgccgcctatgaacgaaaacgcagtacacaaattttgaaattaaagaccgcacttgatgaagaatgtactgttatagctcatcatcaaggtaaaggacaatttgaaaatatgctaggctcaatcagctgtcaaaatcatcgtggcatttttaaaatcggctcaggatttaatttaattgaacgtagaaatccacctccaataggctctattattacctataaatatcgtggattaactaaaaatggacttcctcgatttgccacttattggcgttcaaagaaagaataaaagtgcggtgatgattgatataaaatcttcttatggggctgatattttcctttacaagccgtaaaatctgcctaaaataaagcccccaaatagcttgcatggtcaagctactgacttgtaatcagacttaagagaaaatttatgacaactcaattcaaaccggaattattatctccagccggttcgttaaaaaatatgcgttatgcttttgcttatggtgcagatgccgtatatgccggtcaacctcgatatagtttgcgagttcgcaacaatgaatttaatcatgctaatttaaaaatcggtattgatgaagcacatgcacttggtaaaaaattctatgttgtagtgaatattgcaccacataattctaaattaaaaacctttatcaaagatttacaacccgtgattgatatgcaacctgatgcactaatcatgtcagaccccggcttgattatgttggtgcgtgagcatttcccaaatattgatattcatctttctgtacaagcaaatgcagtgaattgggcgacagtgaaattctggaaacaattgggtttaactcgagtgattctatctcgtgaactctccttggaggaaatcgctgaaattcgccagcaagtaccggatattgaagttgaaatatttgtgcatggtgctttatgtatggcatattcaggacgctgtttattatcaggctacattaacaagcgtgatcccaatcaaggtacttgtaccaatgcctgccgctgggaatattctgttgtagaaggaaaaacagatgaagtaggcaacattgtgaatgttggtgaagaaattcccgttaaaaatgtcgcaccgacgttaggtgaaggaaatacaacaaataaagtctttttattagcggaaaatcagcgacctgaagagcaaatgtcagcctttgaagatgagcatggtacttatattatgaactctaaagatctgcgtgcagtgcaacatgtagaaaaactttcacaaattggtgttcattctttaaaaattgaagggcgtacaaaatctttctattattgtgcaaggacggctcaagtttatcgcaaggctattgatgacgcagcagcaggcagaccttttgatgaaagtttaatggatacattggaaagtttggcacatcgtggctataccgaaggttttttacgccgtcatacgcatgatgaataccaaaattatgattacgggtattctatttctgaacgccaacaatttgtcggcgaatttaccggtaaacgtaatgaacaaggtatggcggaagttgcggttaaaaataaattcttgttaggtgatgaagttgaattaatgacgcccaaaggcaatgtggtttttaccattgagcgtatgcttaatcgtaaaaatgaacacattgatgccgcacttggtgatgggcattttgtttttttagatgttcctcaagatattcaacttgattatgcgttactcatgcgtaatttagttaatgcaaatacaagaaatccgcataataaaaaataatcgtttgttagaaattttttgtgaatgtaaaaaatatttcgccctttcttgatgaaagggcttttttaccctctatttatatcacctaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttgaaaaacctttaaaaataaccacttttatttgccaaagcaccattagaacatttattaaatcaatctggcgtgattttttgtcaagaaaaaattgcttttgatcacgtaaaaagcggaaccattaatgatagcaattattttgtttattatggcaaagtagcatcattggaacaacattttcaattgcaaggcaaaaattatacttgctacgctttttctaatcctccttacccttttgttagacctgcaatttttgatgatgaactcaattttttagagcaagcactctcaaataaaaacaaaattgataaaaagaaagcttttgtgttttttaaacgttatgccaatcaaccgatttgtgttggaaacttccttcaaaaactatcctatctcctctattttcgttggtgcagtcataacattattgacaactttgattttttctgcactagcatggtttatcagttccattattgtcttctggcagcaacgcaaaattccctctgagtatcgacaaaaaatgcgtaaccgagaaccatttcaacgcttatcgaaaattgtgcctcttgttttttaggtgcgggtatttatggtgcggtcgccgctcacgatattctgccaaaatggaacggatttccacaacctcaaatccaacaactttctacgcagtattgctcagccaattggtgccaaaatctttccaaaatcaacatcaaaacaaggacgctaccagctggagtttatagtgcggaagaaaaaacgcgtattattcaaaaaaccttagtcaaaaaaggttacaaacttaaagtggacggaaaatttggtgcaaaaactcgcaatgccgcagtaagttaccttgcgaccaaaggtatcagcgtcactaacgatatcgccttggatcggttgtttgagtattttgaaccaaacttacagtaaaaaacattattttgaagtactgtatattgatagaatgtttattctaatatatagctttttatatgacttaaactctttttaacgtgcttatttctttgctttaattacagatgttcttgtatattatagtttttcatatctgtgatatttatcacaaaaacgaaataaaaattccaaattttaataaaaatgaaaattttgcattgaaataaaagtagtaatattgtattaatatcaaggtatttaagtggttcaatattacagtctgatcactaaatagagaagttcattgctaaatttaatatttacatatgctaaaattgataggaaaattctatgaaaactgcaaaaaactgcaaaaaactgcaaaaaactgcaaaaaactgcaaaaaactgcaaaaaactgcaaaaaactgcaaaaaactgcaaaaaactgcatagcattcttttaactacgctacttatctcccttcctgtactatcacaagctaaaaccctaagattggctcatcatatggctaatgataatgttaaccatacactagttatagatttttcagacaaactcaaagaaatatctaatggaaaacttactgttgatgtttactcaaacgggattttaggcgatcaagtggagctatttgaaggaatgaagctcggtactgttgatatgtccatctcagatactagcatcattgcatcttattattctccaattgggattttagatatgccttatttttttaaggatatggagcatattaaaaaattactaagtacagccaaaatggcagaaattaaaaaacaagttgaagccaaatcaggggttaaaatattaagtattcaacctgtcgcttatagaaatattattctcaaaaaagaacttgctgataataataaatttgatggcttaaaaattcgagtaccaaattctcctgtacttgttaatactataacgttgcttggagctacaccaagtccaattccatcaggtgaggcatacactgctatccaaacaggcgttgtcgatggcatggaaggtaatccggaatttttaagctccattaaaatcagcgaagtagctaaaaattggtatgagacacaacatgccatgacttttactgcgttaaatattagtgctaaaaaatttaattcattaacagaatctgaacaacaatggattaaagaggctgtaacttttgcaatagatcagttttatattaagactgtcaacactgatgaaaaatggagaaactatctaaaacaacaaggagttgtatttcataatgtagacatatcagttttaagagaaaaagctaaaccaatggttgataaatttgttaaagaaaatgagctagaagaactatatgcagaggcacaaaaatgaaattagaccgttatatttcctcattcagaaatatattaacgattatacttttttcttccctggtcattgttgtatctataggtgtgttttctagatttttaacatcacatccatttgcttggactgaagaattatctagatttatttttatttggctagcgtggatagcttcaagtttaacgattgctaagggagttaatattacatttgatattgtgttagataaattagaacaaactatcggtaatattgctcatattatcgtgaatgttatttctattatttacatactcgtagtcattatattgggatacatactttgtattaataatacaaattcatactcccccttactaggtgttccaatgtggactctaaatcttgcgatacctgttggtggggtattgatggtttatgagcaaattaaaaatttaatcaagaaacgttaattataatgaggtgatatatgctacttcttgcattcttatgcttctttattttggttctgctcggcgtgcctattgcattttcgatgggattaggtgccataatttcaattctgtctaatgatttaccgttagcattgatttctcagcgtttattctcaggtataaattccttttcattattagcaattccgttttttatgttagctggagaattaatggagaatggaggaatatccagaagacttattcatttatcgaaatgtttagtcggacattttagaggcggtctaggtatgatagatatatccacctctgtaatttttgccggagtatcaggatctgcagcagcagatacagccgccgtcggttcaattatgatacctaccatgaaaaaaaatggctatccagcaggcttaactgcagtccttcaatcggtagcaggatctcttggtccaattattccacctagcttaactgcgattatttttgcctcattaactggattatcaattaaagatttatttttagcagggattttacctggaattgctatagctatcggattggttctagtcacctatttctatgctaaaaaatataatcttggtagagatcaaaaggcatctagggccattttatgcaaagcatttaaagaggcgtcttctgcattatttatgccggttatcatagtaggtggaattttggttgggttctttacgccaactgaagctggggctgtagcagtactttatgctattgcagtcggtatttattataaagaattaacttttgaaaaattcaaacattcaatactaaatgcagccgcaatgaccgcaatgtgtaccctaattatatcaggagcaactattttatcatggattatcgccttcactcgtttgcctgatttaattatagggttcttaacaagtattacggataatccttacatgatccttctgctcttagtagcatttttattatttatcggcatgtttattgaaactattgccgcaactattattgttgcaccaattttaatgccagtagcttatcaatatggaatagatccgatacaatttgccataattatgatcgttgtcttagtttacgcaggagtaacccctcctgtcggtggagtattgttcattactatggggattgctaatgtcaaactacaggaaacgctaaaatacctcgttccttatttaggtgtcatattcatcgttgtgttactgatgatattattcccttcgatctctttgatgatacctaatatgttccgttaaaaaacaagtgagtataatgtgtttttcattttactcacttgatggcgataatgacacaatttcctcttgtatgaacccatatttgcgactagactacgcccttacagtttttattatgattttacgaagttatgtatttatctgatttctattttgacttacctgatgaattaattgcacgttatcccaaacgtgagcgttcttccagtcgtatgttgcaattaaacggacaaaacggagaattatttcaccgcacttttagcgatgttgcagatctgattaacgaaggcgatttgctgatttttaataatacccgagtgattccagcgagaatgtttgggcgaaaagcaagtggtggaaaaatagaagtgttggttgagcgagtattaaatgaacatcattttttagcccatattcgatcttcaaaatcaccgaaagaaaatacagtgctttttttaggtgaagataagctgggagaagggaagggtgttgaaatgctgatgaaggcacgccatgaaaatttatttgaactggaattaagtgataaaagtaccgctcttttagatattttacagaaaataggtcatatgcctttacccccttacattgatcgtccagatgaagatgccgataaagaacgctatcagacggtctacaataaagttccgggggctgtggctgcaccaactgccggcttacattttgatgatgagctattgacacaactcaaaaacaagggggttaattttgcctttgttaccttgcatgtcggtgccggcacttttcaacctgttcgtgtagaaaatattgaagatcataaaatgcacgcagaatatgtggaagttccgcaagaagtggttgatgctgttttagccacaaaagcaaagggtaaacgagttattgcagtaggtacaacttctgtacggtcaattgaaagtgcggcactttttgccgaagaaaataatagcactcatttacttgaaccctatttttccgacacttccatttttatttatccgggcaaaaaatttcgtgttattgactgtttgattaccaatttccatttgccggagagtactttgattatgctggtttctgcttttgccggttatcaacatacgatgaatgcttataaaagtgcggtcgaaaatcgctatcgcttttttagctatggcgatgccatgtttattacgaaggcctaaaagccgattacatcagactgtttatctgacgagaaggattacaaatgacaatgaaatttaccttacataaaactaacggtatggcacgtcgaggtaccatgacttttaatcgtccgcagggcgaatttacggtggaaacgccagcttttatgccggttggaacctatggcacggtaaagggcatgacacctgaagaagtgcgggcaacaggggcagaaattttactgggaaatacctttcatttgtggcttcgccccggtcaagaaattatgcgtcaacacggtgatttacacgattttatgcaatggcatcgtccaattttaaccgatagtggtggttttcaagtttttagcttaggtaaattgcgtaaaattactgaagaaggtgttaaatttcaaaatccaattaatggcgaaagaattttcttatcaccggaaaaatctatggaaattcaatatgatttaggttcggacatcgtgatgattttcgatgaatgtacaccttatccggcaactttcgattatgccaaaaaatccatggaaatgtctttacgttgggcaaagcgtagtcgtgaacgttttgatgaattaggtaataaaaatgccttgttcggtattgtacaaggcagtacttttgaagatttacgtaaactttctattgaggggttaattaatatcggttttgacggctatgctgttggtggattagctgttggagaacctaaagaagatatgcacagaattttagcatatgtttgcccgcaacttccggcggataaacctcgttatttaatgggtgtcggtaaaccggaagatttggttgaaggtgttcggcgtggtattgatatgtttgattgcgttatgccaactcgtaatgctcgtaacggtcatctttttgtcagtaacggtattgtaaaaattcgtaatgcaaaatatcgtaatgacacaacctccctcgatcctgaatgtgattgctatacctgtaaacactataccaaagcttatttatatcatctagataagtgcggtgaaattttgggggcgagattaaataccattcataatcttcgctattatcaacgtttaatggctcaaattcgtcaagcgattgaagaagatcgttttgaggattttgttgtagaattttataaaaaaatcggtaaatctgtgcctacacgataagaaagtaataataattgtcggagaaataacctacaaggtcggttattgataaataaagtgcggtgaaataaaaagatattttcacattaaaagaattttatgctattttacgcaagtttttaatgaatgtttaactcacttataaggataaaataatggaagctcaacaaagtagcccactttctatgttatttatttttgccatttttggattgattttctattttatgatctatcgtccacaagcaaaacgtaacaaagcacataagcagttaatgtctgaattagcgaaaggcactgaggtgttaacttcaggtggtattatcggtaaaatcagcaaaatcagtgctgaaaacgattatgtcgttatcgcattaaatgatacaactgaaatcactatcaaacgcgattttatcgtagccgtattgccaaaaggttctttaaaatctatctaaattttcattcattccgcaagggaacaagtctatgttaaatcgttaccctttatggaagaatctaatggtgatcctagtgatcgccattggtgttttatattctcttccaaatctttacggtgaagatccagctgtacaaatctctggaacacgagggcaaaccgctgatataaacgtgcttactaatgtacaaacattattagagcaaaataatttacctatcaaatcaattattttggaaaacggctcaattttagctcgtttcaacaatacagatgatcaacttttagctaaagataaaattattgaacaacttggtaataattattccgttgcacttaaccttgcacccgccacaccaaaatggttaaccaatattggcggtagaccgatgaaatgggggttagacctacggggaggtgttcgtttcttaatggaagtggatatgcacactgcattggataaacgccaagaacaattacaagacagcttacgtaccgaattacgcaaagaaaaatatcaatatacgtctattcgtaatggagaaaattttacaactctcattaccttagctaaaccggaacaactttccgatgtacaacgtttcttgcgtaaacaacatcaaaatctgaacgttaatgccatttctgaaaacacactaagtttagaattatcagagaacgctctaagagaaattcgtgatcatgctattgaacaaaacttaagtattttacgtcgtcgtgtagaagaattgggtgttgctgaacctgttattcagcgtcaaggggctgagcgtattgtagtggaattacccggtgtacaggatacagctcgggcaaaagaaattctaggtgcaacagcaacgctggaattccgtttagtaaatcaaaatgcaaatttagatgtcgctcttagaggtatggtgccttctgattcggaagtgaaatatgatcgcaatggtagtcctattgtgttatatcgacgagctgtattaggcggtgagcatattactaatgcaagttcaggcatagatcaaaataccggttctcctcaggtttcggttactttagattctgaaggtggtgaaattatgtcacaaactaccaaacttaatctaaagaaaccaatggcaactctatatgtagaatataaagacagtggtaaaaaagacgaacatggtaaaactattttagctaaacatgaagaagttattaatgttgcgacaatccaaggtcgtttcggttcacaattccaaattaccggcatcaatagccctgctgaagcacaaaacctatcggtattactacgttcaggtgctttaactgcaccaattcaaattattgaagagagaacggtaggcccatctttgggggctcaaaacgttgaacaagggctgaaagcaggattatggggattagccattacgattatatttattctattttactataaacttttcggtttatttgccggcatagcccttattgctaatatggtacttcttgtaggcataatgtctttattacccggagcgactttaacaatgccgggtatcgcagggattgttttatctgtcggtatgtctgttgatgctaatgtattgatttttgaacgaataaaagaagaaattaataatggtcgcccaatccagcaagctattaatgaaggttatagcggtgcatttacgagtatttttgatgcgaacttaaccactattctaacatcagtcgtattatatgctgtaggtactggaccggttaaagggtttgctattacactctctttaggtgtagcgatttcaatgtttactgccattacaggaactcgttttcttgtaaacttaatctatggcggaaaacgtgttgaaaaattatcaatttaaggcaggtgaatagtgagtttatttacacgcaataaaaaagtgcatgaatataaaggggtcattttaccttttaaactaaccccttttatgaaataccgctactggggatatgctttctctatcattgtaactgcggtctgttttttctttatttttactaaaggattcaactggggactggattttaccggaggaacggtgatcgatacccatttttctcaaccggcagacctcaataaagtacgatctacattaaaagagaatggaatagaaagtgcgttggtacaaactacgggaggtgttcgagatgtcatgatcagattacctgtcgtagaaagtagtgctgaagtgggtaataaaattaaaactatcctcaatagtttggatgaaggtcttgaaattcatagtattgaatttgtaggtccgaatgttggtgaagaattaacacaaggtgcaatttacgcaacattagcaacattactgatgttattaggttatattgctttccgtttcgaatggcgtttaggtacaggtgcagttatcgcccttgctcatgatgttattgtcactttaggtgttttttcctacttccaaattgaaatggatcttaccttcgtggctgctattctgtctgttgtaggatattcgcttaatgatagtatcgttgtttttgaccgagtgcgagaaaatttccgtaaaattcgccgtattgatactgttgaaattattgatatttcattaacccaaactctggcaaggacattaatgacatcaatcacaacattatttgtcgtaattgcactttttgctttcggtggaccaacaatccatagcttttcacttgcgttgttaatagggattgcttttggtacttattcaacgatttatattgcaattactctagctcttgatttagggctaaaacgtgaacatatgctaatccaaattgttgaaaaggaagagtttgaagaaggcttctaaactcatgttgtcgggcatttgcccgacatttagaaccaacaaatcaaaacactggaaactgtttaaaaaaataacaatgaaaaatgagtggtaggatttttcacaacaagagttgtttaacacgagtttttttggtttaaaacgttagtcatgtttttcttatgttattctcatcaaaaacctatctgtatcatcttaaggtcgaataaatcgaataagcaagcatagtaatcggtcaaaaagtgcctactgtcttgctttgaaaaaaaagattgtctttctcaatataacgtattgctatgtatagactctactacacgtttttttggtagacggtatgtattttaggcgtgaaaatttttagaagtatttggaggtaattctaaaatcttagttttggagagcaaacggaaaagacagaattattgaaattttaagtagcgattttggggattaacgaggtaactttttggtgctctgagcgagacttgaactcgcacgtcctacggacactaccccctcaagatagcgtgtctaccaattccaccaccagagcgtaatttgaatttaggtttttattgaggaatgtcgctgttttttgtgtcaggtgtcggtatgctttgttgtttttcctgaacttgctccgcaacttttgataaatcatcaaacttaccacttttaacattattgctatgtgaattgatattaccaatcaataaactgatagcaaaaaatgctgttgccaaaatggctgtcgtacgagataagaaattgcctgcacctgctgaaccaaaaactgttcctgaagcaccaccgccaaacgaagcccctgcattagcacctttaccttgttggattaagatgaagccaatgaggacaatggcaatagctaagtaagcgatcagtaaaacttggtacattatttcttctctctaaattcaaacatttctataaacaaaataacgtgcgaatactatctaatattggaaaccttcgcaagtggttttgataaaaattcggttaattgttttaatttcaggcaaaatttaaactgtgtttactcattttttttcaaatctgcttttttattctctttcgtttgaagtcctagtttccgcattgcggaaaaattaaagtaacctaataattcaggtaaaagttcactgagcgtttgcataaattgttgataggatccttgcctgcggctgatgctgtccagttgagcttcccaatgtgcggtcatatccggctgagttgcgatttctggtaaggctttaatgagtgttctgcctgtttctgtactgtgaatattccgcccttttttatagatgaatcctcgcttaaataataattcaataatgcctgctcttgttgcttccgtacctagaccatctgtttcacgtaagatttttttcaattctttattttgtacaaaacgtgcgattcccgtcattgccgaaagtaaggttgcatcggtaaaaggttttggcggttgtgtttttttgctaattacatcacctttttcacaaaataattcatcaccttttttcacaataggaagcaaaggttcttgttgttcatcttcatcctcttttccccaaagttgtttccagcccgcaatttgtaaatttctcgcttgagcaataaaagttcccccagcaatatctaatgtaattttactttttcgatattcagcctcttgacaaaattgcattaagtattggcgagcaattaaattatatatttgttgttcattttggtttaaatgcactgtttgacgttttgctgttggaataatagcatgatgtgcttctacttttttattgttccaacaacgatttttaagtgcgggattgactatattaggtatttcttgatacagaacgctttgtgtcgaaattgcatttaaaatagtatatctctcggcaaaatgttcttcaggtagatatcgacagtcggaacggggataagtgatcaatttgtgagtttcatataatttttgacaaacatctaaaacctcttgtgcagacatggcataacgtttcgctgcatctatttgtaatgcagaaagtgaataaggcaaaggggcggtttctttttctcttttatcaatatattctgtcaccgtcgctggctgtgcggtaatgcgttttactacatttttagctaaagcgttggataacacccgtccttcttcatcctgataatcttcacaggctttacttggttgccaaagtgcggtaaatgttgagggcgttttttcttttgttgcaataaaggcttgaacctcaaaaaaatctttcggttgaaaatgctcaatttctaaatcacgacgtacaattaatcccaagacaggtgtctgcactcggccaacggatagaacaccgttatagcctgattgacgaccacgaatagtgtaggctcgggtcatattaatgccatataaccaatctgctcttgaacgtgctaatgctgatgtagcaagggggataaaatttttgttaggctgtaatttttttattgctttttctaccgcacttggattgagatcgttaattagacaacgttgaatttcggctaattttgtagcaggcaacttggcataactgaaaacttcatcaactaataattgcccttctcgatctggatccccagcattaattataatgtctgcttgatgaattaatttaagtacaatgtccagctgactttttacttcttgtctgggaagtaatagccatttttgcggaataataggtaaatgttctaaacgccattgtttgaacattggattgtaaacatcaggagcagcttgttccaataaatgtcctacacaccaagttacataatcttgttcgccacatttgacaaagccttgtccacgttgatgcggtttaggcaatacgtcagcaatagctcgagcaaggctgggtttttccgctataaataatcgcattagactactgattctagggattgatgaaagccaaatattctaacataaagtcaggctattccaaattcgctaaattttcgctaaaatgccttgcgttttttgattaacttagatggaagaaaattatgttcggaaaaggtggcttaggtaacttgatgaagcaagctcagcaaatgcaagagcggatgcaaaaaatgcaagaagaaattgcacaattagaagtaacaggcgaagctggagcgggtttaattaaggttacaatcaatggtgctcataactgtcgtcgtattgatattgatccttctttaatggaagacgataaagaaatgttagaagatcttattgcagcggcatttaacgatgcagtacgccgtgcagaagaaatgcaaaaagaaaaaatggcatccgttactgccggtatgtctttacctccgggatttaaaatgccgttttaaattaattcatatatgactgggacgcaatgtttgcgtccgtttttttaataagacaattcattatgcaaagcagtcctcttttagaaaatctgattgaacatttacgttgtttacccggcgttggtcctaaatccgcacagcgtatggcatatcatttattgcaacgtgatcgtagcggtggtatgaatttagctggtgctttaaccgaagcgatgtcgaaaattggtcattgtactcattgccgcacttttacggaagaagagagttgtgcaatttgtaataatccaagacgacaaaattcgggttttctttgtgttgtggaacagccttccgatattccggctattgagcaaacagggcaattttccgggcgatattttgtgttaatgggacatttatctcctttagatgggattggtccgaaagaaatcggtttggatttattgcaaaagcggttacaacatgaaagtttttatgaagttattttggcaaccaatccaactgttgaaggcgaggcaacagcgaattatattgcggaaatgtgttttcaacataatataaaggtcagccgtattgctcatggtatccctataggaggggaattggaaacagttgacggtacaactttaagtcattcacttattgggcgtcgtgaaattcaactataacatggttgacgtcctcccccgactttaggtggggaggatgtcaatccttattttatcgttacacgtgcgaattttcgttttccgacttgataaactgcggtggaaggtgaaacaataagttttgcattgtcgactttttcaccattaattttgaccccaccttgctgcaccatacgaatagcctcagaagttgagccaacaagtccagcatcttttaataaattcgctaaaccgatttcgccggtaaaggtaaattccggcatgtcatcaggtattgcccctttttgaaaacgatcaataaattcttgttctgcagtatctgcatcatcagcactgtgaaagcgtgtaataatttcttttgcaagtaagattttgacatcacgtggattacgaccgttttcaacatccttttttaattgtgtaatttctgtgagcgggcggaatgacaacaggttataccaatcccacataagctcatcggaaattgacatgattttaccaaacatattacttggcgtttcggttacgccaatatagttgccgagagatttagacatctttttctcaccgtccaatccgactaataaaggcatagtaattgcaacttgaggtttttgtccgcaagatttttgtagctcacgccccattaataaattgaaggtttgatctgtaccgcctaactcgacatcggcttctaaatgtacggaatcatgaccttgtaaaaggggataaataaattcatgaatggcaatcggttgattattgttaaatcgttttttaaaatcatcacgttccaacattcttgcaacagtataattcgatgccaaacggatcattcctattgtacccaacttacctaaccaatctgaattgaatacaacttgtgttttttgtggatccaatattttgaaaatttgtgttttataagtttccgcattgcgtaacacatcttctcttgataaagggggacgagtagtattttttcctgaaggatcgcctactgttgcggtaaaatcaccgattagaaagattacttcatgaccaaagttctggaattggcgaagtttattaagtacaaccgtatgccctagatgaatatcgggtgctgttggatctgcacctaatttaatgcgtagcggacggttttctttgagtttttcaatgaaatcctgttctgaaaaaacatgatcaacaccacgtttcaattcggcaattacagtatttatattagtcattatgaatccttaatttgaataatattaataagttttttattttccttattatagggattattgattaaaagaaaagtccatagaatataaggttgtcgtaataattcatttttttcttggcgaccaaagtgcgaataaaaaaagcggtcaaaaagtatttccttttgaccacttatcttctattttaaagactagaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgcaaatgtttctcattcaaattttcacataaatcaagcgttaactcgttgggcaaggaaatctaatacctgctctttagcaattatttgtttttcacccgtacgacgatttttatattcaatttcgcctttttctaaatttttttcaccaataacaatcatatgaggaacacctatcaattccatatccgcaaacatcactccgggacgctcttttcgatcatcaaagataacatctacatttttattgagtaagctctgatacaattcttcagcaaaaatttgtacattttttgacttatacatattcattgggataattgctacagtgaacggtgcaatttcatcagaagaccaaataattcctttttcatcatggcactgctcaatagtagcagcaacaacacgacttactccgatgccgtagcaacccataatcatcgtttgtgggcgaccatcctcaccttgtacagttgctttcattgcctccgaatattttgtacctaattggaaaatatgcccaacttcaatacctcgcttaatctgtaaagtacctttgccatcaggacttggatcgccttctacaacattacgtaagtctgcaactttaggtagggcaacatcacgatcccagttaacattaaagtaatgtttgccatcaatgttcgcaccagtgctgaaatcgctcatgagtgccacggagcgatcaataaaagccggaattggtagattcacaggccctaacgatcctatactggcaccaatttttgtttttatttcgtcttcatttgcaaattctagaggatcggcgacttccggtaatttttgtgctttgacttcgtttaattcatgatctccacgtacaatcaatgcgataagaggttggtcttcatttgcaccttttacgatcagtgttttaactgttttttccacagataaattaaattgttcaactaagtcattaatagtttttgcatttggtgtatctactaactccatagttgcactcggtgcctggcgttgacctattgctacggcttccgccaattcaatattggctgcgtagtcggaattgcttgaaaaaacaatatcatcctcgccactttttgccagtacttgaaactcatgagatgcactgcctccaatagatcctgtatcagcttgtacggcacgaaaatctaatcctaaacgagtaaaaatattattgtaagttcgatacatgacatcataggtattttgtaaacattctttgctggtatggaaagaataggcatccttcatcaaaaattcacggccacgcattacgccgaaacgaggtcgcacttcatcacggaattttgtttgaatttgatataagttcaatggtaattgtttataagaactgacttcacgatgcaccaaatcggtaataacttcttcgtgagtaggccccaagacgaaatcacggttgccacgatctacaaaacgtagcagttccggaccatattgctcccagcgttgggactcttgccatagctctgccggttgaacaacaggcatttcaacttcaattgcaccgctcttattcatttcctcacgaacaatattttctacttttttcaaaacacgtaagccggttggcaaccagttatataagcctgatgctaaaggtcgtatcatacctgctcgtagcatcaattgatgacttactacttgagcatcatttggggtttcttttaatgttgataataaatatttacttgtacgcatttttgttcctatatttcataatgttgaatgaaaaaattggcgatagtgtatcattgagtactattgaaaaaaaagcaaaagggataagaaagtaacattttttagtcaaggaaataatcatcttccccaacaccaatgtaatttgagaattcatcagggctaaagccatgagaaagcatataacgccagattttttgtttagttttggaatcttgtttatttcgatattgaggaaattttttgttcaaaacctgtaatactattttgcaccaatcaatttcactttcttgtgcaatttcgtcaatcagttctgcttgaatgccttttagttggtgcaattcttgtttaattcgctgtaagccataaccacgttttgcacgatgataaagataattttcagcaaaacgcttatcattttgccagtttttttgttggcaatgggcgagtgtttgtgcaatttcttgctcagtaaaacgtttctcctgcattttgcagcgaagctcaaattcactatattcacgccgagcaagtaaactcatcacgtagcctaatgcgagagaagacatatatttattttcctttgcggttaaatgtagataaagagagtatggacgaaagaaaatgcggtcgttttaccgcactttctatgatgagagctaaatactcagtactaattaaaaatcactttcaacttcagatatgtttgattctgattcagcttcaagatccgctaacagtgctttttccggatttgctaataattctgaacgtaatttttgctctaaaatagcagcttgctcaggatgttcagctaaccatttcatcgcatttgttttcccttgaccaattttttcgccctcataggagaaccaagcaccggatttatttactaacttatgttttacgccaagttcaataagttcaccatttcttgaaataccctcaccgtataaaatttggaaatcaacttgtcggaacggaggtgctactttatttttaaccacttttacacgagtttcattaccaatgacttcatcgccatttttgatactaccaacacgacgaatatcaaggcgaacagaagcatagaattttaaagcattaccacctgtcgtagtttcaggattgccaaaaacgacaccaattttcatgcgaatttggttgataaagacgaccaaacaatttgagtttttgatctgacctgttaatttacgtaatgcttgcgacataagtcttgcctgcaaaccaacatgagtatcacccatttcgccttcaatttctgctttaggcgttaaagcggcaacagagtcaacaataaccacatctacagcaccggaacgaactaaggcatcacagatttccagtgcctgttcaccattgtcaggttgagaaattaataattctttaacatcaacacctaatttagcagcataaatcggatcaagggcgtgttccgcatcaataaatgcacaggttttccccgctttttgtgcttgagcgatgacagataatgttaaagtagttttacctgaagattcaggaccaaaaatttcaacaatacgtcccattggtaagccaccaatacctagagcaacatctaaactaagtgaaccggttgaaattgcttcgatatccagtttttgggtgtctcctaatttcataatcgcacctttaccaaattgtttctcaatttgtcctagtgcggcttcaagtgcttttgctttttcttctggggttgccattttatacctcaagtaaattatgtatcagaatttatgtacaatattatactgtattcacatacagtgcaatttaaaatttgatatttttagaaattttgcgatctaatcagcaaaaagagaaaattattccgtattattaattaaattttctaatgcttcttgcatggaaaaccatgaaacttcaacatcttcaagtgcttttttaagctgaacctgttcatttaaaagtgcggtgagttttgttttattttctgtttgataaagcactgtatcagaaagcagcatttcaatttcttgtagtttttgttggtatatttgcattttgctttcaagagcggtaatttttttgcgtaatggtgcggtccgttgacgtagatctgcctcttttcgcttttgttctttgcgatgattagcggtgttttcgttgctattgatgattttctcattatgtttcggcgtgctattaatttcatttagccatttttgatagtcttctaaatcgcctgtaaattcctcaacttgtttattatgaaccaaataaaattcttctactgtattacgcagtaaatggcgatcgtgggaaaccacgaccagtgaaccttgataatctattaatgcttctgtcaaggcttgacgcatatctaaatccaagtggttcgtcggttcgtccagcagtaataagtttgggcgttgccaaacaataatagctaaaaccaagcgagccttttcaccgccggaaaaagaagaaacagcttgatttactttgtcgccatggaacgcaaaactgcctaagtaatcacgtaattgttgttccgtttgttgaggagcaattttttgtatatgccagagtgcgttttcttccgaacgtagcgtatccaattgatgctgtgcaaaataccctaattgtacgccttttgctaattggatgtggccggaaagtgcggtcaattctcctgccaataatttaattaacgtagatttgcccgcaccatttttaccgagcaacccgatacgagatcctggtactaaattgagcttaattttttgtaaaatttccaccgtactttctccattgtcataacctgcactggctttttcaatggaaaccaaggggttgggtaaagcgagcggttcacgaaatttaaaggtaaaaggattatctacataagcaggtgcaataagttccattcgttctaaggctttgacacgactttgtgcttgtttggctttagttgctttggctttaaagcgatcgatatatttttgtagatggtttattttttgttgctgttggcgataaagtgcggtttgttgtgctaattttgttgcacgttgcacttcaaaggaagaataattgccactgtattcatgcagtttatgttgttcaatatgaatgattttattcacaataggatcaagaaaatcacggtcatgtgaaattaaaatcaaggtaccttgatattgaattaaccaacgttctaaccaaatgacagcatctaagtctaaatggtttgtcggttcgtctaataagagtaaatcagagcgacaaagcagggcttgtgcaaggttaagacgcatacgccaaccgcccgagaaagatttaaccgttcttgttaaatcctcttgagaaaaccccaatccatgtaaaagagaagccgctctcgcttgaattgtccaagcatcaattgtgtctaattgtgcatgaatacgggcaatatcattgccatgattattttcggtagcagttgctaaggccttttgtaatttgcaatattcacgatcgcctttgataacataatctaacgcacttatttctaaggcgggtgtttcttgatttacccaagccattgcccagtgatttggaaaagtcacatcaccttcttccgcactcatttcttttttgagtagtgcaaataaagaagatttaccacaaccgttttttccgactaagccaactttttgaccggggttaatagtggcacaggtattttctaagagtaaggtatttccacgctttaaagttaaatttgtaaaaaggatcattagataaactcactattgattaataccgatatctccactcataaatcggaacataattagaggtgaaacctgatgagttgagcaaaggtgaagatcgtacatataacttgcaacgcttagatcgatcaaccgcaacattgtctttagtctagtcgtaacgatctaaaaacgattatttatattcgagttagtcgttacgatcggaaagatgattggattcgtcaagttcaaattttagaactttacaaaatatccaataattctacttcaaatactaacgtgctgaatggtggaattgaagcaccggcaccacgttcaccgtaagccaaatgatgtggaatagttaatttccattttgaacctaccggcatcatagataatgcttctatccaacctgcaattacgccacttactggaaattcggctggttgcccacgtttgactgaactatcaaatacagtgccatcaattaaagtccctgtataatggacacgaacttgatcttgacgagttggaattgccccactgccttctaccaacacttcatattgcaaaccggtttcagttacttttacgcagtcttttttcgcattttcttcaaggtattttttaccttcttcttcaatttgcttaaattgtgcttgtgcaatttcgctggcttgttgctgtaattcctgtaacgctttagcaacttcgtttaattctaaagcgggcggattttgattcaatgcgtcataaatcccttttgcaacggcttcagctttaaccgctaatttgctatcgactaattgttgaccgatttgtaaaccgataccataactaccttgagctgaaacatcatctaaggcaacctgtgcaaaaaattgttttgtcattgttttccctttattgtcgttgaaaattatttcttataagccaatacttcgcctacacgtacaggcacatcaacttctaaagagcttgccagttctactttatctgcttggaataaattgatcacagttgaacctaattgaaaagctcccatttcctgtcctttacctaatcgcaccgcactttcaccgctataagtccactctttcacttccgtgctgcgtggcggattaattattccagcccaaacagtactcatactggcggtaatagtcgcaccgactaaaatctgtaccatagtgccgaattccgtatcaaaaacacagatcacacgctcattacgagctaataagttaggaatatgttcatttaaaaacggattgaccgaaaataaatcgcccggcacatagatcatcttacgcaaagtagcatcacaaggcatgtgcacacggtgataatcacggggagaaagataaattgtggcaaattcaccattttcaaattctttagccaattcagtatcgccggccagcagatctactaagctaaaactatgtccttttgcctgcaacaaggtttgttgttcaatatgtccacattgactaattcgcccgtccgcaggtaaacaaagtgcggtaggattttcatcaatttttctcgcatcagcttttaacggacgaataaaaaattcattaaaacttgcatagtccttaaattctgttttctccgcctcttgcatatttacatgatactttttggcaaaaagtttaataataaaatgcgttacacttccccatttttgttttgccagccagccagctgccagagttaaataaagttgtggcatgacatattgaaaagcaattttcaaacgttgccaataagtcggttgttttttttcagcattatacataacaggtttccttagaaaaattgaacggggattataacaagttattggcatgatgtaatcagtagaagtgttattgtttgtcgcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattatgcagaaagaagcgaatttctagcagtgatcgagcgtttaattaaatggaaactcaaagcttaataacatagataagagaatcaattatgcagatcctgttgcaaaaatattacaattatttacgcattgaacgacaactcagtccatatactctcataaattatcagcgtcagctggaaaaaattgtagtgattttacaacaaaacgatattcactcatggcaacaagttacaccaagtgtggttcgttttgtattagcacaaagtcgtaaagaaggcttacatgaaagaagtttagcgttgcgtttatctgctttacgacaatttctaaattatttggttgtacaaggtgaattaaaagttaattcagccgttggtatttctgcacctaagcaaagtaaatatttaccgaaaaatatggatatggaacaggtgcaacaactgctgactaatgagagtaaagaacccatcgatcttcgtgacaaagcgatgatggagttgatgtatagttcggggttgcgtttatccgaattgcaaggtttgaacttaaacagcatcaatattcgtaatcgtgaggtgcgtgtcatcgggaaaggaaataaagagaggattttaccctttggacattatgcttctcatgccattcaaaaatggttgagagtgcggttgttatttaatccgaaagatgaggcgttgtttgtcagtcaattaggcaatcgtatttctcatcgttccattcaaaaacgtatggaaacttggggtattcgacaaggcttaaacggtcatctcaatcctcataaattacgccattcttttgctacccatatgctggaaaacagctcggatcttcgtgcagtacaagagctattgggacacagtaatttatccacaactcagatttatacccacttggattttcaacacttagcacaggtttacgacaaagcacaccctcgagcaaaacgtaaaaagtagttggaagcaggcaaaattagacgaaatactaccgcacttgatggacgttcaaacgcaacttggcaactcaccttgttcaataataatgccgacgttattagcttgtgctatcgctttaggtttacttaattttatttttacccaagaaatattaaattttactcttaattgctctgcaacttcgtaagctactcgctcaattaacaaaaatgggcgagattgaacataattcaatataaactcactcacttccgcataatttaagcaatattttacatcatctgtttgtgcggctcggcgacaatcccacgccatttcaatatcaaaaatgagcttttgcttgatttgctgttcccaatcataaacaccaatttgagcaagtgcggtcaatccttcaataaatattttgtctgtcattataactccgatgaacgaaattccattaggcttatactatcaagtttatgtacaatagacgaacgaaaattttccgtttcggcgattgggagttgatgatgagtttgtttgcgattatttatatgctgttcacttatttgttagggtcaatttcgagtgatgttgtgatttgtcggtttaccgagcgaaacgatgctcgtgtaacaaactcaaatgtattacaaaaaggggggtatcggcttgttttggcagtttttctatgtgatgtcttaaagggtatgttgccagtttgggtaggctattatttagggttaacttactttgaattaggcatggtagcactcgccgcttgtttaggtcatatttttcctattttctttaaatttagtgggggaaaaggggtggcgaccgcatttggtgctatcgcccccatcgcttggggtgtcgccggctcaatgcttggtacttggcttttaatctttctctttagtggctatgttgcattaagtacggtcgtaactgcattaatattgcctttctatgtatggtggtttaaaccagaatttacttttcccgttgcattagtttgttgtttgttagtttatcgtcatcatgaaaatatccaacgtttatggcgaggacaagaagataaaatttggtctaaatttaaaaagtaacgttacatttgcttgcttaaaaatttaaatagaaatctttggttaaggttttaaattctgtactgtattgattgttccgatcataaataaccaactgactttcctcacatttccgttcttctcggctaaaactaagtaataaacgctgtggagttttacctgctttagtgatgattttacattctctaatacaaaaaagaccgcactttttttgtaaactttttccttcttcaaatggcaaaatcaagtgaatttcacccgttaggtttaatagtttttcggcggcgtttagccaatccaagtggctttgtgttagggtatagcgagctagattgcgttgtttactggcacaatcaataccttgcttaaaataaggaggattcgccgtaatgacatcaaatttatgctcacaatcttgtgcaaaaacaataatatcttgttgaaaaatcttgattttatttgcccaagggctttgttggatattgtcttttgcttgcaaataagcctgcggatccaattcaactgcactaatttgacaatgttcagggctacgttgagccaacatcaacgcaatgagtcctgtacctgtacctaaatcaagcaacgtatttgcttgatttatatttgcccatgcacccagtaaaatcccatcagtccccactttcattgcacattgatcttgattaatgtgaaattgtttaaacgtaaactcttgcttttttgccataaatatcctgaaaaatgaccgcactttaagaacaaagtgcggtataatttgccacaaattttttttgaataccaattctttaatgtggataaatatgacatcaacgcaatttgaagacttcgatcttgcccctcaattactaaaagcccttgcccaaaaaggctattctcgacccacagtcattcaacttgatgctattcctgccatcatggaagcgagagatgttttaggttctgcaccgacaggtacaggaaaaacggcagcttttttgttacccgctcttcagcatttgttagattatccacgtcgtaaacctggccctcctcgaattttagttcttacgccaacacgtgagctggctatgcaagttgctgaacaagcggaagagttggctcaatttactcatttaagtattgcgacgattactggtggtgtggcttatcaaaatcatggtgaagtgtttaataaaaaccaagatattgttgttgctacaccaggacgcttactgcaatatattaaagaagaaaactttgattgtagagccgttgaaatactcatttttgacgaggcggatcgtatgttgcaaatggggtttggtcaatatgcagaaaaaattgcagcagaaactcgttggcgtcggcaaacattgttgttttccgctacgcttgaaggtgagttattaatggattttgcctctcgtttactgaaagatccggtgcaatttaatgcagagccaagtcgtcgtgaacgtaaaaaaattaatcaatggtattatcatgcagacagcaatgaacataaaattaaactccttgcacgttttattgaaaatgaacaagtcagtcgtggcattgtatttgttcgtcgccgtgaaagcgtgcgtgaattgtccgaaactttacgcaaacgtggtattcgcagcacttacttagaaggtgaaatggcacaaactcagcgtactaaggctattgataaactgaaaaatgatgtggttactgtgttagttgctaccgatgttgcagctcgtggcattgatattgatgatgtcagtcatgtcatgaattttgatttgccttataacgccgatacttatttgcatcgtgtcggacgtaccgcaagagcaggcaaaaaaggtaccgcagtatcttttgttgaagcacatgactataaattattaggtaaaataaaacgttatacaggagagttgctaaaacctcgaattatagaaggattagagccaagaactaatcctcccaaagatggtgagataaaaacagtgagtaaaaagcaaaagaatcgagctaaaactaagttggaagaaaataaaaaagcggcacggaagaaaaaacaaaaacttcgccataaagacataaaaaacattggtaaacgtcgcaagccaagcgaaaaaatcgctgaataaagcggtaatatatcccctgcctttaaggggattatgttattgatagctcaaaggtataatcttcaattcactttcatcaacaggcaatctaaaccgttggttttcttctaattggttactcataacgacttgcaaatataaaataccgttaagattgaccgcacttaaaatacatcctgttttacgccaagcatgttctaattgcatttcaatttcagtaccaatttctacaagtgcggcagttttggcttgcaataaatacatggcacgtttatttatccctcgatatttggctcgagctatagtttcttgtccaatataacaacctttttggaaagaaatagcttgttcgatttcttgtaaattcagtgcttgtggaataaattctccttgtccgattattgttaaaattggaaagccttgctgcatatccaagtaatcccaatattgtgtatcttgcgtatattcaaggctcattttttgttcccaacataaaatctggcgattacccaaatcaatgcgaatttgtggtgaaatagcaccgcactctttcagatcctgatcaagcatgcccacaatagtccaatttttttcactaaaagtcacttgagaaaaaaccgcatatttttttaattgagctaagccatgattgagtaaatcttggcggattaagagataaaattgttgttctgcatgacgaatcagacgaaaaagagaattgactttacctttcggatcgcaatgtgcggttaatgtggattgaccgattgccaactttgttacatcacaggttaattgtccttgtaaaaatttttcggcatcaacgccttctacataaattaaaccatattgcttaagattaattaacatttttgtccttattcaagattttggatttgttcacgcatttgttcaattaagacctttaattcaaccgctgatgaggtaatatcggcgttaatagatttagacgcaagcgtattactttcacgattaagttcttgcatcataaaatcaagtttacgcccgacagcaccacctttgtgcaaaatagcgtgtgtttcttttacatgtaattgcaaccgatccagctcttcagctatatcaatacgttgtgccaatagcaccatttcttgttcaatacgttgtgtatctgcttgtaattgaatttcatcaaaacgttgttgcaaacgatctcgttgccattgcaatatttccggcataaaagaccgcactttttgtgcctcaacggaaattgccataaggcgttgttcaattaatttttgaactttttctccctcacgagctcgtgttgcaataaactccacaagcaaatcatcaaaggcttgcaacaaatcttcgatgatactgtccaagtcctgttccggcgtttccactacaccggggtagcgtaaaatatccatcagattgatttcaccctctccggcttgtgcttttatatattgcaaagattgaataacctgtttggtgaacttttgattaagatttaagttgagtgcggtttgttttttagtgtcaatacgcaagctacattcgattttacctcgagccagtttttgccgtaatttttcacgcaaagtattctccaatcctcgaaattgctctggtaaacgaaaaaaggtttctaaataacgttgattgaccgagcgaatttcccatacggcatccccccattcttttttaatttcaacacgagcaaaggcagtcatactgtaaatcatatttttatatcctcacttttatattaatttaccggtgctattgtactgttaaatttcttttatgtcagtttgcatgataaaattgcaaaaattttttaacttcattcaaaggaatatgtcatgcgtccaaatgcgagagcaatcaatcaaccccgtccaataaaaattactcgtcattacactaaacatgctgaaggttcggtattagttgaattcggtgaaaccaaagtgatttgtacagcgacggttgaagatagtgtaccacgttttttaaaagggcaaggaaaaggttgggttactgcagaatatggtatgcttccacgctcaacccatagccgtatgcaacgtgaagcggctaagggtaaacaaggcggtagaacgatggaaattcaacgtttaattgcacgctcattacgtgctatggtagatttggaagctttaggtgagcgtgcaatcacattggactgcgatgttattcaagcggacggaggtacgagaacagcatcaatcacgggggcttgtgtagctttaattgatgcaattaattttttgctgaaaaacggtacgttgacaactaatccgataaagggattagttgccgccatttccgttggtattgtcaacggtgaaacggtgtgtgatttagaatatgtggaagatagcattgccgaaacagatatgaatgtggtgatgatggaagatggccgtatgattgaagtacaaggaacagcagagggtgaaccgtttagccatgcagaacttcttaccctattagatttagccaaacaaggttgtgaacaactttttgtggcacaacgtgttgcattagcggaataaagatagtttgtgcaagataaaaaatctacaatatacatttttacaatgtaagaatatcgcaatgaaaatggtgtggaaatacaggggttaaaatgaattttctcggaaaaataatcggttttatttttggttggcgttttggtggtttttttggtgctgttgtcggcctaattctaggacaccttgccgataagaaactgtatgaattaggaagtgtaaattccagcttttttaaaaataaactcactcgtcaatcgctctttatgcaaactacttttgccgtattaggacatttgaccaaagcaaagggtagggtgaccgaagatgatattgcccttgcaacaagcctaatgcagcaattaaatctggatgatgcaggcagacgtttagcacaagaagcatttaatcgtggtaagcaaactgattttcctctccgtcaagttattcgagagtttcgtttaggttgtggacaacgtgcggatttgttgcgtatctttttgagtattcaagtcaaagctgcttttatggataatgaattgcaaggtgcggaaaaaagtgtcttacaaattgtagcagaagagctagggttatctcgtttccaatttgagcaaatacttgcgatggaattagctgctcgacactttagtcgtggcggtttttatcaacaaagtcgtacttaccaacagggaagttatcatcaatatcaagagcaaggacaatatcaaaacagctatcatcaatcaggcccaacgttagatgatgcttacaaagtgcttggtgtatcaggaaatgataatcaacaaactgtaaaacgtgcttatcgtcgtttaatgaatgaaaatcatcctgataagttggtttctaaaggattacctcctgaaatgttggaaatggcaaaagaaaaagcccaacaaattcaagcggcgtatgatttaatttgtaaatcgaagggttggaaataacttaatgcgagtttttttagcacctatgcaaggtgtgcttgatccttttgtacgtcaactattaacagaggttaatcaatatgatctctgtatttctgaatttgttagagtagttgatcagcgtcttcccaacaaagttttttatcgtttatgccctgaacttcaccatcagggctttactttgtctggtacgcctgttcgtgtacaacttttggggcaatatccgcaatggcttgctgaaaatgcccaaagagccgttgaattaggttctcagggcatagatttgaattgtggttgtccgtcgaaagctgtcaatggaagtaatggaggtgcttcattgttgaaacaaccggaactcatttaccaagcaacaaaagctattcgtcaagctgttccaatggaacagcctgttagcgtaaaagtgcggttgggttgggataatgttgatcaggtttttgaaattgctgatgcggtacagcaaggcggagcaacggaaataacgattcatggacgaactaaaagcgatggttatcgtgctgatcggattaattggtataaaattgctgaagtcagaaaaaaattacgaattccagttattgccaatggtgaaatttggcattggcaagatgggcaaaattgtttagccattactggttgccaagatttaatgattggacgaggggctttaaatattcctaatttaagttatgtaataaaattcaatgcggaaaaattagattggcaacaaggtgttatgccgatgttgcataaatatgctcatgttgaaaatgaatttgacaaagggttctatcatattgcaagaattaaacaatggctacaatacctgaaaaaagagtatcctcaagctggcacactttttgagcgaattaaaagctgtcaaagtgcggcggaattacggcataaaatacaataaaaatggcgtgtaatttacgttacacgccatttttcaaccaatgtatttattttacacgagaaacatattcacctgaacgggtatcaactttaatcacttcgccaatttgtacaaatagaggtactttcactaccgcacctgtacttaatgttgccggtttgcctccagttcccgctgtatcaccttttaagccaggatcggtttcaacaacttccaactcaacgaaattaggcggtgtaatcgttataggtgcaccattccataaggttacaatacaatctgcttgatccagcaaccatttttccgcatcacctaccgctttggcatcagcagagtattgttcaaaggtttcaggatgcataaaataccaaaacgcttcatctttataggagtaagtcaggtttaagtccattacatctgccgcttcaactgatgtaccagatttaaagttgacatccaatactttgcctgaaattaatttacggatacgggtgcgagtgaacgcttgccctttacccggtttaacaaattcattttcaataataacgcaaggctcaccgtcctgcataaattttagacctggtttaaaatcactggtagtatatgtagccatatcatcctcaaattaaaagagattgtttttaacaaatgcgtattctaacccaaaatagcataaatagagaagaagaaaattggactgattacctcgcaaaggcaatttccgatcctatagaattacttaattatttagagttaccgattgaatcgtttcagtatgacattgcggcacgtcaattatttccattgcgtgttcctttcccatttgttaaaaaaatggaaaaaggtaacccaaatgatccgctctttttacaagtgatggcttcacagcatgaatttttgccgatggcaggatttaccaaagatcctttggaagaacaacataacagtgttcccaatattttgcataaataccataaccggttgttattaatagtaaaaaacagttgtgccgtcaactgtcgttattgtttccgccgtcatttcccttatgcggaaaataaaggaaataaacaaagttgggtaaaatcgctggattatattgccgcacatgctgaaattgaagaagttattttttcggggggagatcctttgatggctaaagatcatgagttagcatggttaataaaagagcttgaaaatataccgcacttacataccttgcgtattcatactcgcttgccggtagttattccgcaacgcattactgatgaactttgtcggatattgagtgaaagtcgttttcaaaaagtcattgttactcatattaatcaccccaatgaaattgatgaaatattagcctgtgcaatgaaaaaattaaaacatgcgaatgtaaccttacttaatcaatctgtggtgttaaaaaatatcaacgataatgcacacattttaaaaaaattaagtgataaattattcagtatcggcattcttccgtattatttacatttattagataaagttgagggagcaagtcatttttatcttgatgatgaaagtgcggccgctatttataaagaattacaacgcattagttcgggctatctcgtaccgaaacttgctcgtgaaattgctcatgagctgaataaaacgttgtattcggcataggaaaaagaatgaagatcctttaaaatacataaaattttaccgcactttatgtgcttctttaaacataactttctgactcatcaagggactatcatgacagctgaacaaaataaaatcgacacttctggacaagcttctatacaaaaagaattggagcttgatctggatcctatggagccgatacttccgaaaaaaaatcttgcatctaaacaaactttattggaaaaagccaaacgtatttttaagagagcggataagcaaaatagagttgataaagcagaagtgagtacacataaagaagtaatatccgctagtgatgatgaacaacctccaataatcacggaaacacaagagcaacaaataagccaagcaatagacccgactatatctgaagtgcctgttaagacacaaaaagaactgaaaaaaccggaaaattggactatgttaggtgtgttaccgcctaaatatcgccgtatttttattgcattattagttgtcgtcattattttattaattatttcttggttaaaaccggatgataatatagagcaatattttgaacaatcaacaggcaatagtattccgacacaatttcagcctttagatcattctcaaccggttgaaccgagcattttagagcaactgaagaatcctcaaccaaaaagtgaaaatatcacacagaatgatcaggaaaaaaatatgcctgtacaagcgttgcaggtagaaaacgaaccccaaaatatagccataccgataaattcaacacctagtaaggcggacagtccagtagtggaaacaagcaagcgaccaagtattaaagttgaggaagcaacatctcaacctatagcaccaatggaagaagtgaaaattgttgagaaaaacgagccaaataaaaaggcagaaaaacaggtgaaagcagagcagaaaggcgtgcctgttgttgatgcgaaaccggctaatgtgaataaagtaacaaattcacagaaaaccgctctacaaaaaaatgcacagactaaaacccttgttattccgcaaggaacatcactgatgcaagtattccgcaacaacaatttgaatattgccgatgtcaatgcaatgacgaaagcaaggggggccggtaatacattaagtagtttcaaagcgggtgataaagtacaagtatccttaaataagcaagggcgtgtcaatgaattgcgtctatccaatggtgcgaggttcatccgccaagccgatggaagttatcaatttaaaaaataatgatattaagcaaaacggcgtaattttcgcttacgccgtttgattgtcgaactaacattttttctatttacaaccgctctttttctccaccgaattcacttagcaagttttccgttaatttggcaagaatgccggtcattaaaacaaagtctgcatcaaatcgttgtgcaaaatcttcttttgaaatatcgtcattttgttcacgaatttgatcggcaaattttaagcgttttaaactggcatcttcgttgagagtaaaacttaaatgttcttcccagttgagggataagtttgtgatatatttgccggaatttaacaatccgatcatttcttcactgtccaacacttgttgtttgcaacgaataacggcttgatcttggcttccttttaattccgcctcttccaatacagtcaaccattgaggtgagttttccttgacccaatttgtcatcaccaaacttggctcattagcaaatgcaagtggcacaacaggtaaagatcctaacgattttcttaataaagccaaacagtcttccgctcgtttagttgaggcggtatcaatgtaaataaggttattttccgtatcaatccacaacgcagtatgttggtttttactgaatgcacgaggcaataacgtagcgacaatatcatcttttaacgcttgtttttcgatttttttcagtttgcggttttttttttgctcaagttgttcaatccgttcttccagctcacgtttaatcacttgtgcaggcaaaatcttttcttctttgtgagcaactaacaagagttgttttccaacacaaaaatagagagattcactttcacgcaaaggattgctccaaccgaaccggctcatgtctgattgctggcagggagaatatgcacattgttgtaactgtgattgtaaattttctaccgaccaatcaagagatttagttaaacggtaaattaaggcatttttaaaccaaaacattgttcttcctcaaggtttttcatgtaaaataagcactattgtaacttattcgagatgaaaatatgcaacataaattgattagctttattggcggaggaaatatggcacaagccattgttttgggattattaaaacaaggctatcctgcacattacattcgtgtttgtgatccgaaccaatctcgccgtgatttatttattgcgcaaggtacgcaagtaagtagcaacaatgtcgaggcaatacaggatgcggatgtagttttacttgccgtgaaaccacaaattatggcggaagtttgtgtaccgttaagtgcggttgatttttcagataagttagtgatttccattgcggcggggatttctaccgtaagattgaccgcacttttacccagtgcgaaaagtattattcgtgttatgccaaatacgcctgcacttgtttcagcaggtatggcaggtttatttgcgacaccgcaggtttcggtaaacttaaaacagtttgcacaagatttattaagtgcgatgggggaaatttgttggcttgaacaagagcaggagatgcacgccgttactgccggttcaggaagtagtcccgcttatttctttttatttatggaagccatgcaacaggcattaattgaaatgaatttagatccgaaaactgcccgcttattagtgcaacaatcagcattaggtgcagcgaaaatggtgatcgaaaatccacaaatcgctttatcgaagctaagggaaaatgttacttcaaaagggggaacaacagcgtccgccttagcggtatttaatgaacaaaatgtgacgcaaataatcaaacaggcaatgctggcttgtgttaaacgttcacaagaaatggagagtttattttaaatgagagtttcaccattcagctggattgcaatttgtttgtttggctatttttttgcttacggcgtgtttgttccctattttcccgtgtggttaaaatcacagtcctataatgaaaccacaattgggttaattttagccggagcttacttttttcgtgcattaggcggaatttgggtttcctctttggttaaacgtccctcacaacttattagtggcttgcgttatttagcttgggcaacttgtgtcttgatgtttgtcgccggttttatggcaccgcacttttggctactttgtattttaatcggactgttttcgatggcaagttccggaggattgccattaatggacacgctttctaccacttggcaacagcaacaaggtttagattacggtaaagcacgtatgatcggttctattgcctttgctgccggtgtggtgattttcggctatgtgatagaaatgattaatgcgacaaatattgtatggatgttgaccgcacttttattcgtttatgcaatagggcaaatggcaattccaacttatccgccactcgatcatattgaatctacacaacaagaaaataatgaaacggaaaaaacggattttagcttcatacaattattaaaaaacaaagttacactacgtttgcttattgcgatttcgcttattcatggttctcatgctgcctattattcttacagcgttttatattggcaagaagaacttcatattccgcttcaagttattggggggctttgggcattaagtatcgtggcggaaattgtcctcttcttcttttcatcaaaatggtttcgacattggaaagtcagcacattattttatctttctgcgttaggtgcagtggtgcgttggggcggtttaagttttgccgacaatttgggtattgttatctttatccaacttttacatagtatcacttttgcgaccagtcattatgccattatccgctatatttccacacaacctcatcaagcgatggctaaattacagggcttatataacagtttttccgcctgtattgcagtcggtttattagcgggactttccagtcttatttatccaatctcaccgttttatacattcttaactatgatgttgattgcggcactggcgatccctattattccgagaaatatcaatgcctttcgtcaaagtatcatcactcgagtgaaatcatgaaagacaacgcattaattgatctttttttaaatgaactttggttagaaaaaggattatccgagaataccgtgcaatcttatcgcttggatctgaccgcactttcgcaatggctggagcctcaggggttgagtttagaaacccttgatgtggtagatttacaaacattcttaggcgagcgtttgacacaaggttataaagcaacaagtactgctagaatgttaagtgcattacgcaaactttttcaatatttgtatcgagaaaaataccgtactgatgatccaagtgcggtattaagttcgcctaaattaccgagccgtttacccaaatatctgacggaacaacaagtaacggacttacttaacacacccaatacagaaattccgttggaattaagagataaggcaatgttggaaatgttgtatgcaaccggattacgtgtaacggaattggtgagtttaagtcttgatagtatcaatatcaatcagggtgttgtgcgagttatcgggaaagggaagaaagaacgtattgtgccgatgggagaggaagcaaactattggcttcgtcaatttatcctatatggtagatcctttctcttggcagggcagagttccgatgttgtttttccaagccgtcggggaactcaaatgacacgccaaacgttttggcatcgggtaaaatattatgcaatattggctgaaattgatacttctgcactttctccccacgtcttacgtcatgcttttgctacgcatttagttaatcatggtgccgatttgcgtgtggtacaaatgttactgggacatagcgatttgtccactacacaaatttatacacatgtggctaaagagcggttaaaaattttacacgaacgatttcatccaagaggataaatttttttatatttttttgtacgcctgtatcgtataatgctccgttagtttaaaaagacaaagttaaactatttaaaaaattcatttctttgatacataaggagtttttatgaaatacaaactatctttagcaattctgtcaatactgcccgcactttcccatgcgggggggggtaatttcaacttttacggcaaagcaggaatcgatttaacctctcgttttgaaacaatggttctcagaacagaacaaaataattacgtcccgagtattcctgcaagttcaagacaaaataccttctcgccaagtatcttttttgaaactacctacaatattttaccgcaaacagaaatcggtttgggactgggctatatcaaacgcaaaggcttcgatcattctgccagttggcattttgagaaggatatgcaaaaaaaaacgtgggcacaaacatcagctttcacagacatcgaacaatatagaatttaccgttattcttccctaccaatttatctcatcttgaaacagaattatgcgtttaatgcaaacagcaaattttatctaaaagggaatataggttattcaatcaataaaatgcctaatacaaagtatgctcattattcaaatgagtcaagcctaaagattcagaaaacacaaattggcgatcctatttataaaatgaaagcaaaaaacgggctgtatttagggttgggtatcgggattgaatataaatctttcttagcggaaattggttattaccatacccatgcaactatcagttacaaaaacaaaaatacccaatatccacaatattcctacaacaacgatgccatacgtttaacccttggggtgaaattctagaaaatgaaaagcgactaactgcggttagttagtcgcttttatagaaaatttttatatttttttgtacacctgtatcgtataatgctccgttagtttaaaaagacaaagttaaactattttaaaaaatttatttctttgatacataaggagtttttatgaaatacaaactatctttagtgcttttgtcaatattgcccgcactttcccatgcgggggggggtaatttcaacttttacggcaaagcgggaatcgatttaacctctcgttttgaaaccatgcaactcagaacatatctgaacaataacgtaccgagcattccagccagctcaagacaaaataccttttcactaagtctcttttttgaaaccacttacactattttaccgcaaacggaaatcggtctaggattaggctatatcaaacgaaaaggcttcgatcattctgccagttggcatgtacatactgatggagaatgggcagtaagcgcggacaatactgctgttgagtactataaaataaatcgctattcttccctgccgatttattttacgctaaaacaaaattatgcctttaatgcaaacagcaaattttatctaaaaggggatataggttattcaattaataaaattgctgacaccaaatataagaaatacacaaatattacaaataaatttgagttactaagtgaaaatctacgtaaaatgaaagcaagaaacgggctttatttaggtttagccattggacttgaatataaatcgttcttagcagaaatcgggtattatcatacccacgctgcggttaattataaaactaaaccttacaaaagcaaagcagaaggctactatgcttggcattcttacaacaacgatgctatacgtttaacccttgggtttaaattctaaaaaataaaaacgtgattaattgatctgcacctaaaagttggactaaacaaccaacgattagtgtgcagatttttatgacaaaagataacccatctttcaaatagcaaatcatcgttgagttttatttatcaaaaaagcagtgatcgctcactgcttttttacggtcgttcaactaggttaccaagcccagccgatacccacaccgccgccgaagtcgccgacagagttactatttccgtgtaatttcaacagaaccttaccgttatcactcacacgagaatagcctaaagcgaccgcactttgacctttatacgtaccggcagagactgaaagcactgatttacccggaatcgaaatcgtaggcaatgccgccgccgcattcgaaccggcaattcctgctcgagattctttactaaacgcatcaaacctattttcaagctggttgaattttttgtcagtatgtgtttgtaaggcatcgacatatcctttgttaaccacggcattcggtgaagagttcggcgttaaatccggcactctgatttctcctttcgccccgtcaatctcaatgcgttgaccttgcgggttggtcaaggttaatccgcttggcgtcaaagtcgcactgtgcttaccgtcagtcaatctcacgccgtctaccccatattgtgccgattggccgtctttatgagttacccgtaatccgttgccgtcaagacgagatttattcccttctacagtttctttggtttcaaaagacgtcatgtttttcaacttatcggacagtttgacttccagtcccgtctcggaggcgtccactttaatattgcccgccgccgtggtcgcactgttaaactcsccctcgcctttgatgrtcaatttctcgcctaaatttttatggacaggcacgccgtcrttgccctcaaaatttaagcccgcttgwcctaargctttcamrtcttgcagattggcagcacgcttcacatcaacgctggaatcacctgacaacaacttattgactgcgtcatcttttgtggctaatgcggtttgatacgctttttgcttctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacatctcgcccactttcgccgtcaccgctttagcctcagttttcactgcttcgcccgcatttttcacgttttcagcttgctcttttgctttatcggcatcaatacccaaaccgctagccacgttgcnnnnnnnnnnnnnnnnnnnngtcggctcggctttgatcacgactttttttgcttcatcgccagaaagttcttgatcaggttttccgtctttnnnnnnnnnnnnnnnnnnnnnnnnnnctttaactactttttggccatttaagtaaaaatcaaatgggcggttgctattcagagcttccacttgcttatccacatagtttttattagtagccatatcgccagtagatttatcgtctaaatcttttaaacctgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtcgtatctcctaaaccacttgcaacacctgaaattttaactttatcactgtttgattttgtgaatgttaatgtcgctccactttcagggcttaactcaatttgctttttaccattacttgtaattttaagacttccagcatcagttcctgcagtgatggtcgcctcattctcttttaattcaagttttgatttaccatgagctaattctacagttgctttatcagcattaagtgtcaatttagattgactgtctttactactaatttcagaaacgccactgaatttatcttctgttaatgttacagttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacccttaacagtaaaattcgcggcgacattggctaatcttttatctaaatatgctttattgacagcatagttatcataagcatcttttttagggttagctgacgtatcatcaggaataccattttcaattaatacatttttaaaagtaggtttatcttttatacctattaataattgcttactatcttttagatatgctgtttttatattatcaggaacgtatccatcttcttgagtagtagttggtttatctatagctcccgctttaatgattaatttatcacctaaataatgcgttccttgttcagtatcgccatctccactgccaaaaataaagcccttattaattttatctatatttgcctctattgccgctttaaatgttttttcttcttttagtatctgtccattttgttcagttccatttttaaatttattaaattgtgattttttaaatgtaaatttaccgttatcaacttccgcacctaatacatttgttgcaaagttctttaattgtaaaaagttaacagcatgattgtcattcgttggtgcttcagtaattgttacactcttaaattcaggatcgtcttttaagccgatagtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtaatcgcctgatcggaagtcgctgaaatttcgccatcagccaaatgtccaaattttattgtttcccctatgtcagcagttgtttttccatcagcaagtgtttgcgtttgttcattaaatcctttagcaccaacgaagactttgctcttgtcaatgtcgcctaatttttttaaaggttcgccatttcttgtatctactctataaaatttaccgtcatctgatgctttcgttaatttaattattttgttatcgctttcaattgtataataaacaaccaacccctcttttttgacatattctaatgtttttagctgaccaacagtcgccacatcagaatccaacgctcccggtgcaacatttattattcttctaagtcccactgcctctgtgtttgtaccttcgctaaccttccaaccaccaacagatatcaccccataagaggcatcattttttatttcgtaagttgaacccgcagctttataagcatctaatttagaagctggttctcccgataatttaggcgtaaatttgtcgcttgcatctgcatttttatcataaaaataattagttgttgatttatatcctaatgcaacagaattagacaaattggcttcagcttcattacctaatgccaacgcacytgtagcttytttayctacacytgcttstataccaagtgcsaywccwytttcygcttgagattgygmyttataaccgatagmaacygaatatykttkacctgaatacgtattattccctaaygcaattgaggcttgaccaatggcacgygtaaaacttcctattgcaaaggmatctttyycttttgcaaatgaaaatctyccrattgcaatcgcactatcttctttggcgtaagcrtatckyccaatygttagcgtattgtctccyaatgcsaccgaatacgawcckatsgctatwscwccttgattatatccgagtgaatctcttgattgtttcgcttttwaytctyccgttccctcttgtttggtcgttttaggtttaattaaacgagaataagtttgtatatctgctgtatttcctttttcatataattcttcaaaatcaaattttgtaccatatgaatttttcttatccgttaaagtaaagccattattattttgaagtccatcattattgaaattatcatccatctctatatttgctaatgcataatttccaattgccaatgaacctctaccgcccgcatacgaatcggaaccgtataccatagcaccatcattaattgcttgtacgttagtacctaccccaactgttctatctgcatatacatacgatttgtttccaagaactaatgattctttaccaaatgcgattgtatctgaaccaattgctgttgaataatctttaaaggcaatggcaaaggttccgattgcagtcgtataatcaccgtatgcaacacttcttgccccaactgctattgaatttttccccctagcccatgtgtgagtttttctattatcgtatttaactccatttaattttttttctttctctattttgtttccaccgtccttatctaaatatttttcataggcgacatttactttagaatcatattcttgttttcgtagataatcgtctttcttttttattttttcaatttcacctctttctgtaactttatcatatgaatgaccattgtttttataaaaaacctcttcaccattatcatttttgataagataataactactccatgttctaccatcgtctcttacaaaataatctccatttaatactagagcactaccatctcttcctactaactcccctttgccattaacatattcattttttccgacaccatcaatacctaataaaaatctaaaatcaactgccggatattcatctgtatagttaaagttttgtgcattatttagaaacaatctaaagatgtcttttggtagttttttttgttttgtatctgcatttccgataccgtctgatccaatcgcaattgaagaatctccccaagcaactgtatcattccctaatgatgtcgcccctgctcctctcgcaaaagttctatatccaaccgctgttccttgtgcattagcattatcaatatttttacctttagtgttttctccgacaatcgctttatgtcctattgaggttgcaccaattccaccacccacagcacgagaacctataatgactgcatatttggcgtgttgattttcaatactagattcagcacctgctttatttgatttgtctgctaataatattagttcttgatgttggtctttaatatttctatttgctccatcataccaaacacttgtattgtagttagatttacctctttcgctggatgtattattatctatccacacatctgccccatacgctacactcgacacccccgacatcgccaacgccaacggcakgaccttaaacgcycctaacaywccgccgaaaaacacaccgcacttcggcttactctccgaactgctcgctatttggcgattryttgccaactckgaaacggctttacattgacctgttgtaatatcatatttggttttgaagattttgttcatatatctattctctttaaaaatggatttttaaattaatgatttctttcgttgattgattgtttagtaaactttgtaggaattggttataaacctaaacaggaaatgccttgttttttaaggcacagcagaaaaaggcgaatgatatcttcgctaagggttttaaaagagtagattggggtatgacgagaagttaaaaactttttaaaatttattttgcaaggtttataaaaaggcgttagcctaggctgtaggctgtaggctgtaggctgtaggctgtcatttttctattctattgttgtttgtcaagtaaaaatttggattattctatctcaaaatttttatggaaaaaacaaatttcttacttttttattctaattcagagggtgatttttaattacgttgtttgatgtcaaagcgaaatttaatgaaaatgaccgcacttttgggcacaacaaaaatccctattggatctgatttcaatagggattggctgtttttaaattatggtaggaatactattttttccaattatattcaggattgataatatcttctatttcatgccaataagcagttagtacgacattgccataagcataagcccgaagtgcatagggcggataaacaaagtttattccttcattattgaagtaaaattgttctgaaatgttgaaatcttcttttgtgatcataccaatatagtcatcattcgcttcttccatcagattggtataaaagttccaaagcacttcttttagcttgctttgttggtcttgcttaacgatgtcgtttagttcaagtattttctttttatgactgtcaatattctgaaatagggttacatttatgccgtgagcaccgccggtataagtatcaatatcgttactgaacgtaatgatattattgcgttgccctagataatttgacgttagatggaatgatgcacctaatacacggtcttcttttgcactttgaacgaattcatcatgaatttgttgaaatttttgtacaagatcttgttttgtcggcgtgtcttttttcatgctatcttcaccgcccactaaggtataagcatgtttgaccaataactgatcaagccattttataccggtttcggataactcaccacgaacttcaatttgtgcattgtcagtagtatattcatcggaatgcgggtaatttacggtttttacttgatcaaagataacgtttttcttgacttgtaaagtcggaacgtcttgttccagacaagctgccaatagaacagttgtcataagagagaagaataaaaagatttttttcatatgattgccaaagtttagtggagtaagaaagtctttattataagttggcagagtatgaatgtaaatttttcttttgggtaagaataaatcgatatattaagtcgctattcttccgtataatatgggttttatttagatagaacgcaaggatattttatgaagcaaactactcaatcgatgaatatagtcgatatattgatcgttacagtgatcttttttggtatgccgatttatacttctctgtcgcaatttttcttattgcaagaaggtgcggtcgcaattacagacacgttgacatttacggatcaggataatatttgggcaattttgatagaacttatctcattagcgattgctgcggtgtatttaaagctaagacgctttgattttacgcagcttaccttttcttttaacgctaaagcgattgtgctgaccgcagggataattttgattgccggcagtctcagcgaactttatttctatttggcagctccctttcaagatgccggtgcatatctcacctcggctgaggttgcacctacagatacaacatcgaccttatctttttacctcgtcctcttttcattgctcaacggtttttttgaagaagtcttttttctcggcttgatatttgcagtgaataaaaaagccttgccttatgcgattgtgttcagcttagtcatccgttttttgtttcatacctatcaaggtatgttttatgcagtaaacgtattgttattcggtatcgtgttgctaatacttcgctctaaaatcaaaaatttattaccgtttacgttagcacatgcgttctttgatgtgtttggattggggttgttacccattattgatattgtcgaaaaaattatcaaataaaaaggcgtattaaatacgcctaaataaacaatcggataaccgttagaaacggtagttaagatttaaaccgtataaattggcacgtgccgttgattgataatccgcacttatattaacgagtttaatctcttttccaatattttgtgtttctctaaattgctgttttttacctcgtaaatgagcaaaacctacgtcaacagaaagatttggcgtgaagttataggttgcccccaagctataccaagtgcggtcggtatcggggattgaggcacttgggtggtcggctgactcatcataagcaatacctgcacgcaaggttaatttatcatttacatcgtaagttgcccctaaggctatacgtgaactgtcatgaaatttttcatctttatggaaagcgaccttgccgttatcataagtggcatgtaaactttgtaaacggctccatttagtatatttatagctgtagtgcatggcgaatttttccgttaattggtggaaaccggaaatttcgaaataatccggcaaatgtagcgttaacccacctttctctttaacaggactaatttttcctggtttaagttgataactcaacgcatcatcatctttaaaattaatatctactttagaatgataggcaataccgatacggttaccttgattaaattcatagactgccccgatattccaaccaaatccccatgcattattatcttgtaattgtattatgctagtatccgaattaacttttatttgagctaatgcagcaagcagttgttgtgatgacggatccaatctgattataaaaccccctgcttgtcctcctggtgttgatatttgcttaacagtaccaagtgcttctttcaaaatacctgcatgacgctcaattttcgctttggcataaaccgcattcaacccagcaccgatgcttaatcctttgctgatacggtatgaaccgcttaaatttaagttaatggaattcagtgcggtggttccacccaaaacaccggcatcataatcctttttatatttactttgtaacccaaagttcacattcatacctgcaccgacagcaaatttatcattaataggtgcgacgaagtacatattgggaataactgcacttggcacaatgtttttctgatccccttttccagtttcaattctctgaaataaccccgcattaacattaacctcaccatttatattaattctagattgaacgtataccccccccattgagaattgtttcgttttaaacaaactcattaacgccgggttggttgccacaactgcggcattatcagcaattgccgcttcacccgcataagctcgtcctaaaccagaactggacacctcagcaatttggaacgccgctgcattaacgtaacttgccgataatgccaatgctgaagcaatgaaagatttagtaaaaagtgattgtttattgctattcattttttatttaatacctctatatatggtgaagttaaattttccgaattctaatgtaagagtagtattgggacaaatgaatttacggatttgttaagtggtcataccaggcggaaatctttcatttactaaagtttataagaagaatttagctgtggcagacaataaatcagtgagttctagttcctcattttgtagaatgttaaaaactttttattgtgttttttgggggaagttataaaggttgagtaaaaaattgtataattcgttataaataacgcaatataatgatttaatgttaaggaaataggaatgacattgtacaaaatattggtgaatagcatcgctatgatttgttttagcgtttcccttgtagcacaagcaaaaataacggtttttgccgctgcttctatggcaaatgtgttagaagaaattaaatctgaatacatcaaagtaaatcctcagcaggaaattgatttttcctttgcttcttcttctgtcttagcacggcaaattagtcagggagcacctgcacagttgtttatttctgcggatcaaaaatggatggattttttagcggaaaagggggcaattgtgacagaaagtcgtcgtgatttggttggtaacagattggtgatgattgcacctcaaaatagtttgattacctctgttgatttgcctaacgctcaatggcattctcatttgaataatacttatcttgcagtaggtgatcctgctcatgtaccggcgggaaaatatgcaaaagcggcatttatctttttggggcaatggaatgatttagaaactaaattagctcgtgcaaataatgtgcgtgcagctttagcattagttgaaagaggggaaagtccgttgggtgtggtttatgcaacagatgcggcggcaagtaaaaaggtcaaaacagtggcgatttttcctgaaaatacgcaccctgcgattgaatatcctatcgctattgtgaacgggcaagataatgaagaaagccgcaagtttttggcttatttgcggtcagaaagtgcggtcaaaatttttcaacaattcggtttttcagtgaaataatttttatgttagatgtgataatcgattatctacgtttatctcaatctgaaatcaatgcaatctctttgagtgttagagtggcgttggtttcaatttcggtgagcttaccttttgctattgctgtcgcatggttgcttgcacgcaaagatttttggggtaagtcgattattaacggtcttattcatttaccgcttgttttacctcccgttgtaattgggtatttattattaattgctatggggcgtaacggtattattggtcgctatttactacagtggtttgattttagttttggctttagttggtacggtgcggcgttagcttctggaatcgttgcatttccgttgcaggttcgtgctattcgtttggcaattgaaaatattgattttcggctggaacaggcggcacaaacgttaggtgcttcttcattgcggatattttttactattacgttaccgctttcattaccggggattttatcaggaatgattttgggttttgcacgatctttaggtgaattcggtgcaaccattacttttgtatctaatattcctcaagtgacccaaactattccgctggcgatgttttcttttattgaaacaccgggtgcggaatattcggcatttagactttgtgttatcgccattattattgcattgatctctttgtcaatttctgaatggctggcgaaacgaatgcaacaaaaattggggtaaagatacttgtaattataagcctgtgccgagtgatactttagcggtaatttttgattatttattttacaatcgttcatcatttcctgtatgaggctttatcgtgtcgttatttctatgtgctgaagaaagattagtgcaatgtgcaacttctttaattgaacagtttcctgagcaatacaacactacactttttcaacaaattcaaaaagataaacataatcaaaaaacgcaactcgggcaattaggttatggattatatttatcagattttgtgtttgaaactttgcaaaaacaaccgcactttctcaaacaatgttggcatcaactccctactttagctgattgcgatcgatatttcgttcgcttacaggaaatactgataaataccgaaacggaagaacaattttatcgcaaattacgtctgtttcgtcatcgtgagatggcaaaacttagcctttgtcaaagtttaaatttagccacagtagaagaaatttttattcggctttctcaattagctgaaagtttgatcattgctacaagagattggctgtatgaaaaaatttgcacagaattggggacgccaacggatacacaaggcaatcctcaacaattatatattttgggtatgggtaaattgggtggatgtgagttgaatttttcttcagatgttgatttgattttcacttatccgacaaatcagggggaaacacggggaggacggcgtagtattgaaaatggtgtatttttcacaagattgggacaacgcttaattcgtgctttagatgaatatactgttgacggttttgtatatagaacagatatgcgtttacgcccttttggtgaaagcggtgcattggtgttaagttttaatgcgatggagcaatattatcaagatcaaggtcgagattgggaacgctatgctatgataaaagctcggattttgggagcaaatatgcaagatccgaatgtaaaaatattacagcaattattacgctcttttgtttatcgccgctatattgattttagtgtgattcaatctttacgtgatatgaaaaataaaattgccggtgaggttcgccgtcgaggattgttggacaatataaaattgggtgctggcggtattcgagaaattgaatttattgtgcaggtttttcagcttattcgtggcggacgtgaaatcattttacaacaaccatcgctgcttcatcttttacctgcactggaaaaattgggtttaattgataccgagcaaagcacaaatttatatcatgcctatttatttttacgcagagtggaaaatattttacaagctattgatgataaacaaacgcaaacgttgccaagtgcggatatcgatcgtgaacgtttacttcttgctacaaaaaattttacctattttccgatatcgacggaaaatgcgggaaaagaaaccgcacttgctcaatatcctattgcaaattggcagcaatttttacaggtattgcatgaacatcagcaaaaagtgcggttcgtttttcgaaatttaattggcgaagatgacgatgaggaagaaaaaaatattgctgatgatctgtggcacgactttctcaatgcggacattaatgagcaagaaattaaagtcatattgcaggaaaatcaaatagatgagcaatattttgatgaaattattgaaaaattgacacagtttaaactggatttatctcgtcgatcagtgggagaacgtggtcgcagagtattaacgcaattaatgccaatgttgttccgtcaagtatttcgatacaaaaattctcagcaacttttacctagagtcttgaaaattctggataaaattatcacgcgtactacttatcttgaattattggtagaaaatccacaagccttaactcagcttcttaaattatgtgcacaatcaaaaatgattgctgaacaagttgcaaaatatcccattttacttgatgaattattagatcctaatgcactgttaaatcctacggattttaatcaatattcatctgaattacgccgctatttacttcgtttaccggcagacgatgaagaacaaattattaatgggttacgccaatttaaacaaaccgccttattacgtgttgcggcagcggatattttaggggcattacctgttatgaacgttagtgatcaccttacctatttagccgaagcaattatcgaaaatgttgtcaacctcgcttggcaacaagtcagtctaagatttggtacacctgaatatttgaaggaaaatcaaaaagggtttttagttattggttacggtaaattgggcggcattgagcttggttataaatcagacttggatcttgtttttctctatgacggaagtcaaacaggacaaactatcggcggtaaaaaatccattgatagcaatcagttttatctgaaattggtacaaaaaataattagtatttttagtatgaataccagtgcaggaatactttacgacatagatattcgtttacgtcctgccggtgatgcagggttattggggtgttccttaaatgcctttgaaaattaccaactgaatgaagcgtggacttgggaaaaacaggctttagttcgttgtagggcggtatacggcgatattgatttatgtgaacgctttgaaaaaattcgttgtaatgtgctttcagctccaagaaatgtggaacagctgaagcaagatatacgagagatgcgtcaaaaaatgtatcatcatctctctaaacataaaacggacgaatttaatattaagactgatttgggcggaattaccgatattgagtttattgcacaatatttggttttagcttatgctccccaacattcagcattaacacgttggtctgataatgtcaggatatttgactgtatggctgaaagtgcggtgatttcacaagaagtttccacaaagctaaaaaaatgctatgtaaatttacgaaaccaaattcatcatttaaatttattaggtcaagaaccgattattaatgcacaactatttagcaaggaaagaacctttattctcaatacatggaaaagtttattggaatgaatgaacttataattgccctaaaatcagcatatgataagaaattatttatcatttgtattttctttgttatgctatgcagacctttaacttacattaacaaatgagaaataaacgatgaaattaaataaatcacttttggtcggcacattagtcgcctcaactgtattattagcagcttgtaatgaaaaaaataaagcggaaacaacgccaactgaaccggttacagttgcagaaactcaagctcaacctgacgttcaaggaaaaactgaaacaacytcrwctgaaycaaccgcarytgraaayacacaayctgawkctcaagaaaaagttgtttcagaaaaaagtgagacagttgaacaagaaattcttaatcagtttaacaatacagttacgatccaattggtggggtatcagagtgaaaaaatagagggtgaagatactttatctttcgtttataacgttaagaataaaggtgataaagcaatcaaagaacttcagtggtataaccttgttttctttaattcgactctggtagagcctctttcaatagcctattcttttgaggatacgcttgctccggaaggcgagggcgaaataaaattaacaaaattagctaaaacttatgctgaagagattcgtgcagatatactaaaaccggaagctaatcttcaatttagcccaataattgcaggtcgaattatttttgaagacggtacgcaattagttgtaactacagatgaagagcttactcaatctttacagcaaattttaacgcaataatttttaaaaataattattcaatgtgctagttatctatccgctcttacaagctataatatttataaataactacaaaaagttatcaataaggttttatagattggtaagagcggttatgtttccgcattgaaatctactgcccattattggcgaaaccgaaagaaattcgtcgtaaaaagcgtgcagagcaacaagaaaaagaagtgtgaagaaaaaaagctgagaatttgctaaaaatcagctcaacaaaccgcactttaataataaaaatttctgcgagaaatcatgtaaaaaaaataacaccctcttaacaagaagagggtgaataatcaatttaccattggtaccctatagaaactgaacctgccattttgccttgagaatttctatttccttgaaatttaagcataatcttaccgttatcactcatacgagaataaccaatcgccattgcgttttctccgccataacctgctgcagaaatggctaacatagatttacccggcatagagactgatgtcaaccctgccgccgcatttgcccccgcaattcctgcacgtaaatttcggtcagtattattcaattgtgtacgcaattcattatttctaccgtccacatagtttttatttaccaccgcacttccagtggttgttggttggatatctggtacggtaataatacctttttcaccatcgatcttaatttcaccacctacacctttaacagttaagccttttgcaccataggtagcagtagcagtagcagtcttatctgttacagttaagctatcgctatttaacgtcgatttcttaccgctctcatctttggtttcaaaggctttcatatttttcaaagtatcggacagttttatttctaaaccatcattagttttattagtttctaccttgatattgccagcggcactactaaacgaacttgtagtttgaccgttttgagtttcctcttcccctttaataattaaggtatcgctcagttttctatgaacagtcttatccttaccactctcattcccagcaaaactcaaccctgcttgtgcaaccgcttttaaatcagcgagattggcggctttgtgtagttcatcttttgtcatttgttgcccttgctgaccgttcataccctcagcaactaattttttcactagctcaagcgttttatcttgtcccattggttgatcttgagtgccattatcaagccctaaaccggatttgaggttattgatggcaacaggtgggtgagaagtactaccatttgtgtcttttccgcctaaagtgatagtatttttcgcttcactatcatatttcactgccactttatccgcttctgcctgtttatcggcgatggtttggattttgtttttcacaaattttttcaccgcaccggcagtcgtgagttttttgtcttcagtatcagcatcctctttaatatcttcagtcgcttcaatcttaaaggaaatggtgcctgtattcgcatcaatactcggtttgatatagtcatcaccttttaacttaattgtcgcaccaagttgacgtgtcattttgtttgctgtggtactaccagcctgatctgtagacgttgtagtactactattgtccacttcaaaaattaaacctttgttaatggtttcgatgtttttatcaatagcttctttgaaagtagctgcggcattgacagtatcgtcttttccgtctttatctttcaatttagcaaaagttggtgctttaaacgtttttgtcttgtcatcaacatcagcccctaaaatatccgtccctaaattaccgaatacacggataacttccgcaagctgtccgccattaatcgcatcagttgaatcaggcrycactttacctgcggcaacatgggtaataatgcgttctgcacctgtatcgcccacactgacgaccgaattaaaytkaccatytttagacgtwcctgcmwytttccargtraayatyaaactatttttaccyacgttaatgtcagyasttkyaaatrcgtttttsktyktttccmatttwgartttttccccaaggcgaaagaaycatcatcgtccttgtcgctaagttgaataattcccaatttatctgttactttttttgccaatttaagcgtaacgttttgtttgccctgttcaactttcgtttcaatctcatcttttgtgcctaatacttgcaaggcttgcgatctgagtttaacctcagcttgtgcttttccgcttgtagatggcgtacctgtgggctgtggtggttgcggttgaggttgtgcttgtgccgtgttggaattatccgcttcaatttttagcgttaatgaatccaattgagtttttaagtaatttttaaccgcactcaccgttactaatttattgccgttttggtcggttgtactgcctgaaccccccatgccttgaccattcgtatcaattgaattagccacattaagtttaaaggtgattttgcctccattgctaccgccactgccattttcagtcgccaacgtgaggtatgagtcgcctttaaacgttaaggtttcgcccagtttacgaatgaaaggattgtttccgttctgtgttgatggttgagttgtacttccatcttccaccgcaaacttcaagcctttttctacaagggctttggcgatgtcggacaagtctttcacattgacagcgttgttggaaatgttactgccattactaccaagatttccttcgaggacattttcaatattgctatttccgctacttccgccattgctatttacccctaaaccacttccaagtttagtgatttgtttattacctaaatctaagccgtctttgccaaaggtaaatgtgccagtgccagcggtgattttgaccgttggactagttgggctaccactaccattcgtaaattcaattttcgctaccgcacttccgttacttccgctaatcgtgctaatacctttcaaatccttattcaaagcgatttctaatgtgtctttgcttgtttttgtgaaaatattttgatgggtatttgttgcaccattttgcaccgcacttgtcgctgggcttgaagcatcgccttttgctcctgtaatcgtcaaggtcgagccgaggtagagttgttgctcgctgtcgcttccaccacttccgttagtatcgcccttgaatttcaagccctyrttgattttagcgatgtttttatcaatcgcatctttgaaagtacttggtgcgttactactggtctcatttccacttgcatctttcaatttcgcaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatttttccccaacgcaatagaatcccctgcggcggtttcaaccaccgcactttcgccaatcgctaccgcacctgcggctttggtttcggcatctttaccgatggcgatagctcctatggcagttgtagcaaccgtcgcttttttccccaacgcaatgccgtaatcggcttcgactttggcaacgctaccgatgaccaccgcggctttccccgaggctttggtgacttgtgagttgccgctgccggtatttgtgccgtcatcgtctgccgtgccgataacgatactgtacatgcctttgctcatttccgttttcgctacgccaatggctaaagaatgatcagctttagcaccatcgttgtttttattcgtttcagcctttaatttattaacagagaaatacgagactccgccaccgccggcatttttcatcgcttctcgcaattgccctaaattgacggcgtgtgtatcttccgtccccggtgcgacattcacgatttgacggtattttgtatcttttttaccgattgatagtgcaccgccgagtttgtcttcaaatttcttagcaaattcctcacttatccatgtttttgctttagcatcagtcttatcatcttttgtaatcatagaagagccatttcctgacggactatcagcttcagattcagcacccaaagcgattgcatcggtatgttgattatccactctcgcattgtaaccaatagcgacggctttttgagactccacagaagaatgtgcccctaaggcggttgattgtgaaccttttgcataagcacgatgccctaaagcaacatcgtcaatttgctccgcataagattgcatacctagtgctactgtttcgttaccataggctatggcttccgaacccaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatctagaattgtatcgggtccaatttttgattcgttagctgttaaaccactcaaaactatattaatatcctgaccatacacaaaactcccagtcaataaaaacgccaacggcaataatttaaacagccctaaaaaattgcccgaaatcccaccgcactttggtttattttcagaacggctcgccacttggcaatttttcgccaattcagacaccactttggtttgtccagtggttatatcgtatttggttttgaaaatcttattcatggtttactctctttaatcttttaaaatgggttatttaataatttattttgttgatttttttcacttttttatggttgtgaatggattaaactttttgttttttaggtagattaatgaggtataaatcggcgatgccttgctttttaaggcaaagcagaaaaagacgaatgatattttcgcaaaggggtttaaaaggggaaatttgggtatgatgaaaagttaaaaactttttaaaatttattttgcaaggtttataaaaaggcgttagcctaggctgtaggctgtaggctgtaggctgtaggctgtaggctgtcattttttcttttctattttatttgtcaagtaatcattaagcagtagaattttgcgattctatcctaaattttattaagaatgaaatagttttttcattttttttgtttcgatctcgattatatagtgaatcaagatgtttgaggggaaagataaaggcggagtttggcttttttttggttctaattacaggttatgttttggcgagattgctatataatgtcgaattatcttaccgatttatcaattttcttttctttgggagtaaaagatgactcaagcgaagatttattccgtttcacaacttaaccaatccgtacgccaaatgttagaagggcagttagggtcggtttggttgacgggagaaatttccaattttactcagcctgtttcggggcattggtattttagtttgaaagacgaaaatgcacaggtgcgttgtgcaatgtttcgcatgaaaaatatgcgtgtcggatttaaagcacaaaacggaatgcaggttttggtgagagcttccgtgagtttgtatgagcctcgtggcgattatcaattgattattgagtcaatgaatcttgcgggggatggcttattgcaacggcaatttgaggcgttaaagttaacattggcggctgaagggttgtttgcacaacattacaagaaaaacttaccgcactttgcaaaatctgtcggtattattacgtcgcctaccggtgcggcgttgcaggatattttgcatattttgcaacgtcgagatccgagtttgcatgtagtgatttatccgactgcagtgcaaggcaaagaggcaacggcagaaattgtacagatgattgaattagccaataaacgtcgggaagttgatgttcttattgttgggcggggtggcggatcgttagaggatttatggtgttttaatgaagagagggtggcaagggctatttttcattccgagttgccgattatcagtgcggttggacatgaaattgatgtaactattgcggattttgtggcggatttgcgtgctccgacaccttctgctgccgcagagcttgtcagtcgtaatcaacaagaattattggatcaattattttaccgcaaacaacgtttggatatggcattggatcgtttgttccaacaaaaagtgaagttgttgcaacgcttgcaatttcgcttgcaacagcaacatccgcaaagccaattaaaaattcaacaaaaaacggtgcaacaattacttcatcgtttacatcttgcgttaggtgcttttgtcgataaaaaacagcagaaaatgaccgcactttgtcgtcgtttagacaattcacctttgccttattatgtgcaaaaacagcaccaaattttggttcaattggagcttcgtttgaatagcggattacaaaaaaaattcaaaaatgccgattatcagcttagtcgattatgtggaaaattagacagtttgagtccgttgaaagtgttggctcgtggttattcgattacgaaaaatcagcagggacaggcgttgaaaaacagtcttcaaattgaggtcggacaactgatcagcacgcaattagagcgagggattattgttagtcgtgttgaagcgatggaagagtaaactaaaggtgcaaataggtttgctcctttagtttgtgtatgggttgggggagttagttgcgtttaccgaaaatagcggttccgattcttaccatggttgaaccgcactttattgcacttgccatgtcatcactcattcccattgataatgtatcaattttttcatcaggaaacgccagttgtagttgagtgaataaatatttcatttgattaaatgcttgttcttgtgcggtgatattatcagtcggttcaggaattgccattaaacctcgtaggcgtaagtgcggtagattttggatatgttttgccaaactcaacatttcttgaggttgaatacctgatttgctgttttcagcactgatattaatttgaattaggacatttagtggttgtttatagtgaggtcgttgttcatttagacgagtagcaattttttcacgatcaagcgtttgcatccaatcaaagttttcagcaactaattttgttttgttggattggagcggtccaataaaatgccattcaagttgaatatgttgttctgtaaaatattgaattttttcaacaccttcctgcacataattctccccaaatgctgtttgccctgcctgataagctatcagaatatcctcgaccggtttggttttactgactgctaataaggatactgtggaagaatgtctttttgcctgttcgcaatattgagatatttgtcggtttattttcgctaaattgttttttatttgcatcataatgagcaagacctgttgaagttggtttgatatgggcattattttaccttaattattcgacagggggaaatttatgaaaaatttttcattttctatttgacaatagcataaaatttcggtatttctaacgcactcttttttgattttgaaataaccgaatgtataaccgcactttttctattaccacgatgattattaccattaagatgattaatggcgtgggctagtgcataaaaaataggatttacaaagcccgcctcgtaaaaaagtgcgggtttttttattaacgtttttattattaaatcttcacaacatataaggaaaaattatgcgagtactcaaatttggcggcacatctttagcgaatccgcaacgctttttacaagcagcagcacttattgaaaaagcacatttagaggaacaagccgccggcgttctctctgcaccggcaaagattaccaatcatcttgtagcactttctgaaaaagccgctttaaatcaacctactgatggtcattttgatgaggctcttgagattttttataatattattaatggcttatatgcagaaaatactcattttgatcttgttggcaccaaagcattaattgagtcggagtttgcacaaattaagggattattagaaaacattcgtcaggcgggaaaagtagaagatgcggtaaaagcgacgattgactgtcgaggtgaaaaattatctattgcgatgatgaacgcttggtttgaagccaaaggatatacggttactgtgattaatccggtagagaaattattggcttatggatcttatttggaaagcagtgtggatattgcggaatcaactaaacgagttgatgcaaaatctattcctgctaaaaatattgttttgatggcaggatttacagctggaaatgacaaaggcgaattagttttattggggcgtaacggttctgattattcggcagcgtgtttggctgcttgtttaggtgcaagtgtttgtgaaatttggacggatgtagatggtgtttatacctgtgatcctcgtttagtccctgatgctcggttactttccagtttatcttatcgtgaagcaatggagctttcttattttggggctaaagttattcaccctcgcactattggtcctttagttgagccgcaaattccttgtttgataaaaaatacgggtaaccctgaaggtgcaggatcaattattgataatcgtgaaaatatttctgaagggctacaggttaaaggcattactaatttagataatgttgctatgttcaatgtatcagggccgggtatgcaggggatggttggtatggcagcgcgtgttttttccgccatgtcaaaagccagcgtttccgttattttaatcacacaatcttcttctgaatatagtattagtttttgcgtaccgactaaagctattgaaaaggcaaaagcggcactaaatgctgagtttgaacaggaacttgtcgctaaagatcttgatcctgtggaagtaattcatgatttgtcaattatttccgtagtaggtgatggtatggagcggtctaaagggattgccgctagtttcttttcggcgttagctagtgctaatatcagtattgttgctattgcacaaggatcttccgagcgttcgatttcagcggttgttcctttgaataaggcgattgaagcggttaaagcaactcatcaggcattgttcaataatcgtaaagttgttgatatgtttttagtcggtgttggtggggtcggtggtgaacttattgaacaaattaaacggcaaagtgaatatttggcaaaaaaagatattgagattcgtgtttgtgcgttggctaattcgaataaaatgttgttaaatgaaaatgggttaaatcttggtaattggcgtgaagatttggcaaatgcaacacaaccgtcagattttgatgtattgctttctttcattaaattacatcatgtggttaaccctgtttttgtggattgcacaaccgctgaaagtgtagcaggattatatgaaagagctttgaaagaaggctttcatgtgattacaccgaacaaaaaagccaatacccgtgagctggattactataaccaagtgcgtgaaaatgcacgtaaaaatcatcgtaaattcctttacgatactaacgttggtgcaggattgcctgtgattgataacttacaaaatctattagccgccggcgatgatgtagtgagttttaacggtattttgtcaggatctctctctttcattttcggtaagttggaggaggggctttctctttcagaagctaccgcacttgcccgtgaaaaaggctttacagaaccggatccgagggatgatttatcagggcaagatgtggctcgtaagttattgattttggcacgtgaaatcggtttagaacttgagttgtcggatattgaggtagagggcgttttaccgcaaggtttctcagagggaaaatcagcagatgaatttatggctatgttaccctcattggacgaagaatttgccgagcgtgttgcaaaagctcgtgcggaaggtaaagtgatgcgttatgtgggacaaattgaagaagggaaatgtaaggtttctattattgcagttgatggagatgcaccgttatataaagttaaaaacggtgaaaatgcgttagctttttatactcgttattatcagccgattcctttgttattgcgtggttatggtgctggtaatgcggtaacggctgccggaatttttgccgatattttaagaaccttaaaacattaattggagtgataaatgttaagaatttatgcacctgcatcaagtgcaaatattagtgttggatttgatacattaggggttgcagtatctcctattgatggttcattgttaggtgatgtcgttcagattgaagaaattgaacagggatttgaactggaaagtgcggggtattttgtgcgtaaattgccaaaagaaccgcaaaaaaacattgtttatcaagcctatgtgttatttagtgaacgtttaaaattacgcaatctgaaaataaagccgttgcgtttaacgttagagaaaaatatgcctattggctcgggattgggatcaagtgcttgttctatcgtagctactttagtggcgttaaatcaattttatcagcagccattttctaaaatggaattgctggaaatgatgggcgaactagaggggcgaatttcaggttcaatacactatgataatgttgcaccttgttatttgggcggtgtgcaattgatggtgcaatctctaggtaatatttgtcagcaattacctttctttgataattggtactgggtattggcttacccgggaattgaagtttcaacggcagaagctagagcaattttaccgaaaagctatactcggcaagatgtgatttctcatggtcgtcatttagggagttttgtacacgcttgtcatactcggcaggaagcattggcggcttatatgatgagagatgttattgcagaaccttatcgtgaagcattattgccaaattttgctgaggttaaacaggcagtgaaggatttgggcgtacttgcttcaggcatatctggttcaggtccaactatgtttgcgattgctccggatttagctattgcgactaaatcggcaacttatttagaaaacaattatttacaaaataatgagggctttgtgcatatctgtaaagtggataatgtgggtgcaagggctttagtttaacgagaacaagttatgaatttatataatattaaacatccggaacaacaagtaagtttttcacaagctgtgcgtcaaggtttaggaaaagatcagggcttattttttcctgaaaaattaccgcactttgacgacattgatagcctcttatctttgcctttggttaaacgcagtcaaaagattttaactgctttaattggtgcggaattgtcacaagaaactattagtgcaatggtaaaaaatgcctttacatttccggcaccgatggtcaaagtagaagataatatctatgccttagaattattccacggtcccacgttagcttttaaagactttggaggacgttttatggcacaagccttagcagctgtgcgtggagacagtaaaattactattttaactgctacttctggcgataccggtgctgcggttgctcatgctttctatggcttagaaaatattgaggtagtgattttatatccaaaaggtaaaataagtccgttacaagaaaaattattttgtacacttggcgggaatattcgaactgttgcgataaacggtgattttgatgcttgtcaagcattggtgaaacaagcctttgatgatgaagaacttcgtcaagctgttggtttaaactctgcgaattcgattaatatcagtcgcttgttggcacaagtttgttattattttgaggcggttgcacagttaccgaaagaaatccgtcaagacattgttatttctgtgccgagcggtaatttcggtaacttaacagcgggattaattgccaaaactttaggcttaccaatcaaacgctttattgcggcaaccaatgccaatgataccgttcctcgctatttgaatagcggaaaatggcagcctcatacaacggttgcgactctttccaatgcaatggatgtgagccaaccgaataactggcctcgtgtagaagaattatttaaatataacggctggtctttaagtgaattgggttcaggtgcattgagtgatgaagaaacagaaaaaaccttgcgggcacaatatgccaaaggttatttatgcgaaccgcatggggctattgcgtatcaggtgctaaaagatcaattacaggttaatgaaacgggtattttcctttgtacggcacatccggcaaaattcaaggaaaacgttgagcgtattttaagtctcgagcttgtgcttccggaaacattggataggtacaacaaattgccattgctttctgatgaaatggaaaatgacttcgctcaattacgtgcttatttattaaaaaaataaagcattttaaattaaaagtgcggttgaaagtcggaaagtttcgattttatgtacatataataaaagagtgggattcccactcttttgtttgctgtactgtttttttagacaagaaaaacttttaattcgggagcttatgcctctgattttcttgatagacttgcttgaattttattttttgccactttcatcacagttttgtacattgctacattttccgtaaagatacagattgtgtgtttttaatttgatgccatgttccgcactgatttcacgttggcgtttttcgataacttcatcattaaattcaaacactttgccacaatcgacacaaataatgtgatcatgatgttcttccggtgctaattcaaaaacagatttgttaccttcaaagttatggcgaataagaatatttgcctcatcaaattggttaagtacacgataaacagtggctaaaccaatatctttaccttgttccagcaacattttatagacatcttcggcggagaaatgttgcattgtgcctctactttcttgcattagagacaaaattgttaagcgtggttctgtaatttttaaacctgctttttttagtagcttgatattttcttcagacatggtagctcctcaaattttatgccagttcagctaaacacatttcgtcatacacttgtttaacccatttttctacacgttctgcggtgagttctggttgacgatcttcatcaatacataaacctacgaatgtattgtcatcaactaaggcttgcgagacctcaaaagtataaccttcggtcggccaatgcccaacgataattgcaccttttggttcgataatattgcgtaccgtacccatcgcatcacagaaatactctgcatagtcttcttgatccccacaaccaaaaatagcgactaatttatcggtaaaatcaatttcttctaaggttggaaagaaatcgtcccagtcacattgggcttctccataataccaagttgggataccgatcattaaaaaatcatagctttcaatgtcttctttactacttttagcaatatcacgaatatcaatgagttctgaacctaattgtttttgtatcattttagcgatattttcagtattacccgtatcactaccataaaataaaccgacaatagccatttttatctatttccttgaattttaaaataatcttttaagatcgttataattaactctcaatgactaatcgcttgttcagacgcctgacttctaactgctgaactaaatccacatgtaacttttactcaatacgttttagaatgctaaatttatcgcattgaagttgattacatttgtttattcggagctgttgttcatgaagcagtgaatttgttctaggcgtcctactttgggaagcgtcgcaaacagatttagtgtaatacaatctgcatcttgtttagccgttttcaaaccactgaaaatatatcaattctagcctggttctaattgagaatgataagctacaagcaaaatttgaagcgaactataacacaatttataagtgaattaaaccctatagatcaagtaaacatgagaatttttatgacaaaaaacgctgaattgatctaatcacaaaatctgctttttcagcatgtacccaatgcccacttccattgattgtaaaagaggtcgcttgtggaaattgagcgagaatttgttcactgtattccggcaaaatgtaattcgataatccacctcggataaacagtgttggtttgtcaaaaaatcctttttcccaattcataatattggcgtaattttgtttaagtgcggtgagattaaagcgaaatttttcttttgcttgtgcatcgaaagacttgagcataaattgctgtacgctttcttgtggaatatagttagccagtaattgttttgcttgttgacgagtttccgattgtgctttacttactgcaaaaagtcccgcaaatacgctgtcatgcccattgttgccgtaattgactggtgcaatatcaatcacaatgagcttttctattaagtgcggtcgtagcattgcacatttcatcgctgtttttccacccatagaatgcccaattaaaataacgttggttaaattcaaatgatcaatgacttgtagaacatcttccgccatcagctgatagttcatttcttcactatgaaaactttgtccatgattacgtaaatcaagacgtaaaatagggtatttttcggaaaaagcacgagcaatgacaccaagattattcatatcaccaaataaaccgtgaatgaaaacaagagtgggggagatttgcgagttgtttatagcgttaaattggtaattgagtaatttagtcgtgggcataatttttgcgtgtgtatttgtaaagaaatcgttataatgtgcgaaaaattcaaatagatcaagtagaaatctcttgtaggcttgtaatgtaaaaggagttcggttatgaaaattattgaagttgacgaagagctttatcagtatattgccggtcaaacgaagtctatcggtgaaagtgcgtctgatattttacgccgtttgttaaatcttccttattctaacgtagcaagtgcggtacaaaattcggaaaatgtatctacagaagcgattttaccaaacacttgtatagaaagcgaacaggaagttcaaacgaacgaattaataaatattcctgtcaaaaagcagtctgatgaagctattcagaaaattgttgataaagtaagaaatcttttatattcagaagaattccagcaagaaacgaaagctgttgtgcgttttttgagcttgttgcgtacactttaccgcactaatccggaaagttttgcattggcaacggaaagtttgcaaggtcgaacaagagtttatttcgcacgtgatgaggctactttactggtagcgggtaatcatacaaaaccgaaacaaattcccgacactccgttttgggtgatcactaatactaatagcggtcgaaaaatgttgatgttggaaagtgcgatggaatctatgcatttaccacaagaactcattgaagaagttagatctttttttgtgacgaattagcgatgttcttttggcataaatatgcactcactcccttatttcaatcaaaaatagccttgcgaaactcgcaaggtgaagtctttacttggcaacaactttgttctttaatcaatcggcaatctctactttttcagcaacaaggtgttaaagcaggttcgggcgtgttgttatgtggtaaaaatgatttttcattattgttggcttatttggcaactattcagttaggagcaagagttttaggtgttaatccgagttttcctgccgataaaattcagcatatcgcagaatgttatcaatgtgattttatttttaataggactgctttcctgtttaaaaatatgcaaaatttgaccgcactttctgtgagcgactgtacgcaatatgtagatgttttacctgaaactgaagttaaaatggatttgcaggctgtggcaactttaactttaacttcaggatcaagtggtttaccgaaggcggttgtacatagtttgcaggggcatttagataatgcgattggcgtttgtgagctaacccaattcagtgcaaaaaacagttggcttttatctttgcctttatttcatgtttccggacaggggattatttggcgttggttggtaagcggtgcagaattgcatttaccgcaagaggatttttatttttctgttagtcaggcaagtcattgttcgttagtaccgacgcaacttcaacgtttattcgattattggcaacaaaatcctactctctcacgttacacagagcatattttgttaggcggtacgcaaattcctacgcagttgactgagaagttggcacaatacagtataaaaagttacaccggctacggtatgacagaaatggcttcaacggtttgtgcaaaattgagtgatggtaaacgtggagtagggcagccgttagcggggcgtgaagtgcggttagtttgtgatgagatttgggtgcgaggtgccggtcttgctttgggttattggcaacaaggtaaaatttgttctttactgaatgaacagggttggtttgccacaaaagataaaggcatttggcaagataatgaattgcacattttaggacgcttagataatatgtttatctccggcggggaaaatattcaaccggaagaaattgaacaaattattggacagaatgaaacagttgaacaggtttttgtattaccggttgatgatgttgaatttggacaaagacctgtggcaatgattaaatttcacggcattttttctgagcaggcagtatgcgaattacaaatttggttagcggataaattggaaaagtttaagcaacctattcaatattttccgttagtgttgcaagcacagggaaatattaaagtttcccgtcatcagttgaagtccgagctaactcgtttattaggaaagtaagtatgaagaagataaaaaataaattcaaacaagttgccatgattggcttattctctttagctcagtttgcactggcaggagcaattttgaccgaaaatgatgtaaagatgcgacttgatgagattaaaaaaatcgaacaaccccagcaagaagataaaagtgcggtgcaaaacttggaagaaacattgtttctcttaggaaaaatagcaaaacagaaagaagacaatctaaagttacaaaaactgattcaagatgcaccaaatgagcaaaagaacatcagagaggaaatcactacattaaaagaggcgtttgttgttcgtgattttgataatttgtccatcgggcaattagaggataacttagcaaaaatacaatccgaattacaacaagttcaagctgatttagtacaagctaatgcacagttagttaatcaacattctgcaacagagcgagcacaaagtgcgttaagtgccaatattgttcgtacacaagaaattgataaattgtcttttagtgttgatattgcacctgaggagcaaaataaattagctacagaaagtgcgttaattgaattacaaaatgactacaatcaaactgtattacaagggaataatgaactcaccgcactttatactttgcaattagaattgaaaaatcttgtccaacagcatttacaagctacgcaaactgcgttacagacggaaattaatcgacgtaaattagtgcaaactgagcaacatgtggagcaactaaaacagattcaaaaggaagcagagggtaatccgttattagttcagcaacaacaaattaatattcagattggacaagatttagtggaacaaacaactaagctgaacgctttgtcgcaagacaatttgcgtattaaatctgttttggataatttgcaacaaactgaacgtaatattaatgaacaaattagtgctttacagggaactttagttttatctcgaattattaataagcaaaagcaattattaccgcacgataggatgattacaggattatcaaatcaaattgccgatttacgtgtgaaaattttcgatttaacggagttaagagatagcctttatgatattgacggttatatttccaatatagaaagaaagcaaggggttacttttggaatggctgaacactcacagctcagcaaaattttacgggagcgtcagaagggtatttctgatttggtgtctattttaaatgatcaactcaatctttcaatcaatattgaattaaatcaaaaacaagtcaatttaattagtgatactttacaagaaaaactccaacaacaaagtttctgggttaagagtaatacacctattgatttggattgggttaagcgttttccttcactactaaaaatagaattggaggatattcgtacgcaatttaatttcaacaattggcaagataatattatttctgccactgcgttaattgttttcctattatccattgccttttttatttcttggcgtaaagaaaaaattaagcaacggttgaattatattaatagcaaaattaatacgttacaggaagatagacagctttacactccggaagctgttttttggacgattattctttgtttaccgatgacgttagttgtcttagtcggtttaattgttattacttttatttgttttaatgatcctgaaaaattctggttgtggtcagtaagaatgtcgggttattggtggcttttcgcttttatgttagcgatgttacgcccaaatggccttgcttatcgtcattttagtatgcctaaacataatgtagagcttttttccaatgtgatgaaacgatcagtatggattactgttctttggcttaatgcctctatgtttacttatttagatggaggaattgctaatgatgtgattggtcaattgatgacaattgcggtcttagttatttcactgtttattattggacctcgtatgcgttatgcagtccaagcttatgaaaaaaactcagaaaaaaaacctttcctaaaagttttccgtattgtgttgctactctctcctattattctcattgtgttggtggttttaggttattactacactacgttaaatttgatggatcatttgatgtcttcttattttgctttaatgatatggatagtaattcgcaatatagtgtatagaggatttactatttctgctcgtcgtttagcttatcgtcgtttgcaagaaaaacaaaagaaaacacaggtacaatctcaagatgtggtggataaagaagagtttaaccttaatacacaagaggaagttttagcaatttcagccgttaaggatcaagttttgcgagtgatggatttagttttactcgtcggcttaatcggtatgttctattgggtttggtctgatttaattacggtagcttattatttggaaggcgtaacgttatggaaacaaactgccataacagaagttggtacagttattgaaactattaccctgtggaatttgttattagcactgattattttaggcatcacgtatgctttagtgcgaaatattggtggggtattggaagtattaattttttcaagagttaatttttcacaaggaacaccttacaccataacaactttactgatttattttatcattgcaatcggtagtgctatggcattctctactttgggtatgtcatggtcaaaattacaatggttatttgccgcactttctgttggtttaggttttggtttgcaggagatctttgctaactttgtatcaggtatcattattttatttgaacgtcctgttcggattggtgattttgtaacaattgacaatttttcaggaactgtgtcaaaaattagaattcgttccacaacaattatcgattctgataagaaagaagttattgtacccaataaagcctttgtaacagagcgaattgtgaattgggcattgaccaattctatgactcgtgttgtgattggtgtcggtgtggcttacggttcagatttagaattggttcgtaagttgttgttgcaggcagcgtatgaaacacctacggttttaaaagaaccggaaccgtctgcttattttatagcgtttggtgcaagtacattagatcacgaattgcgggtttatgtgggtaaattgtcagatcgtatgactacacaagactttttaaatcgtcgtattaatgaactatttgcacaacataatattgaaattgcatttaatcagttggatgtatttattaaaaatcaaacaacaaatgaagaagtaaaagtactttcagagaatttacaaagataaaaggaataaaaaaatatggcgggaaatagtattgggcaacttttcagggtaacgacatttggagaatcccatggtattgcgttgggctgcattgtagacggtatgccgcccggacttgctttatccgaagatgatattcagccggatttggatcgtcgtaaaccgggaacttcaaaatatactacgccacgccgtgaagaggataaagtacaaattttgtccggtgtgtttgacggaaaaaccacaggaacaagtatcggtatgataattaaaaataccgaccaacgttcgcaagactatggtgaaataaaagatcgttttcgtccggggcatgctgattttacttaccagcaaaaatatggtttacgtgattaccgtggcggagggcgatcttctgcacgtgaaacagtgatgcgtgtagctgcgggggcaattgctaaaaaatatttgcgtgagtattttggtattgaagtacgaggttatttatcacaaatcggtgagataaaaattgatccgcaagtggtagccgatgtgagtaaaattgattgggcgaaagtaaatagcaatccatttttttgtcccgatgaaagtgcggtggaaaaatttgatgaattgatccgagaattgaaaaaggcaggaaattctattggggcgaaattaactattgttgctgaacatgtgcctgtcggtttaggcgagcctgtttttgatcgtttagatgcggatttagctcatgctctcatgggaattaatgcggtaaaggcggtcgaaattggtgacggttttgcagttgttgaacaaaaaggaacggaacatcgtgatgaaatgacaccggaggggttttgttccaaccatgccggcggtattttgggcgggattagctctgggcaaccgattatcgctaccattgcgttaaagcctacttcgagtattaccgttgtagggcgttcagtgaatttaaataatgagcctgttgacgtgattactaagggacggcatgatccttgtgtgggaataagagctgttccaattgctgaggcgatgatggctattgttttattggatcatttattacgctttaaagcacaatgtaaatagaacacataactatgttaagaaaggtaaagttaatgctgaaaactgcggttttttttaccgcactttttttcactcagatattaagtgccaatccacaatattggcaatcagtgaaacgacctattcatggtgaggcaatgcctataggaagttataataatggctgtcttattggtgcggaagcattgccctttaatggcgagggatatcaagttattcgtactaataaaaatcgttattatggacatcccgatatgattgcttatttgcaacgtctcggtaaaaaagcaaaacaggaaggtcttccaacgattttaatcggtgatattgctatgccgggaggaggacgatttttaaccggacatgccagtcatcaaatgggacttgatgcagatatttggttgcgtttaggtaaactttcggctaaagatgcacaagatccaagtggaatgggactgttggttgttgaccgaaaaaaacagagagtcattgataaattgtggtcaaaagatcatgaaaatctgattcgtttagctgctcaagatccacaggtcagccgaatttttgtaaatcctgcgattaagttgaaattatgccaaacagtaaaaggtgatagaaattggctacaaaaaattcgcccttggtttgggcatgatagtcatttccatgtgcgtttaacttgtccaaaagatgctaaatactgtgaaaatcaattgccaattccggcgggagagggatgcggtgaagaactttattcttggtttaaacctgctaaaccaagtgaatttaagcccaaaaaagtggtgccggaagccccttttctttgtcaacagttaataagtgcaccaaatcgtcatgagtggttagaataggaataatatgatagtagaaattactcttcaactaatgttaattttgtttttggtcgctatgatagccggctttatcgatgccatggcaggaggtggcggtttgattactattcctgcactattgatgactggtatgtcgccggcattggcacttggtacgaataaattacaggcttgtggcggttctttttctgcaagtttatattttttacgcaaaagagcggtagatttacgtgcttttttgttgattattgtcatgacttttttgggggctgcattaggcactttatctatccaaagtgttgatgcaatcttaattaagaaagttttgcctttcttggttttgattattggcttatattttttattgactccatcacttggtaataaggatagacaaccccgtatttcttatagtttatttgcattcagtatcggtctgacagttggtttttatgatggtttttttggtcccggaacaggctctttactgactcttgcttgtgtaagtttactcggttttaatttagcaaaagcaacggcacatgcaaaagtgttaaattttacttcgaatattgcatcattgctttttttcttacttggagaccaaattttttggaagttgggcttggtcatgatgcttgggcaatttattggtgctaatttaggcgctaaaatggtattaacaaaaggaaaaaccttaattcgtcctatggttgtattaatgtcttttattatgacggttaaaatggcttatgagcaagcttggtttagctggtaaaccgatgaattattggagtaaacatgacagaaaataatgatttacgtttaaccgcacgggtcggatatcaacctcattactcttggtcctatttattgcctaaatattggggtatttggctcggtatttttgctttagtaattttagcttttgttccttttcgctggcgagataaattggcgacaaaattgggcagaattatcgctcgtaaagcgaagaaacagagacatcgtgctgatgttaatttgcgttattgttttccgcattggtcagaaaaacagcgtaatgaagtgattgaaaatatgtttattactgttactcaagtgatgcttgggatcggtgaaattgcattacgttcaaaaaaacacctgaaaaaacgtagtgagtttaaagggttagagcatgttcagcaggcaagagcggtaggaaaaaatattattttaatggtgccacatggttgggcaattgatgcgtcggggatcattttacatgcacaaggaatagcgatgacttctatgtataacccacatcaaaaccctcttgtggattggttatggacgatgactcgtcagcgtttcggtggaaaaatgcatgctcgtcaaaatggaattaagccttttcttaatcatgtaaagaaaggtgaaatgggctactatttacctgatgaagattatggtgaggaattgagtgtttacgctgatttttttgctacttataaagccactttgccgggattaaataaaatggcaaggttggcaaaagctgttgttattccgatgtttccacgttataacgcacaacgtgggaagtatgaaatagaaatttgtgcacctttagaattaacggaagatccagaacaatcggcgagaatgatgaatcaagcaatcgaatactttgttactccaacaccggagcaatatgtctggattttacgcttattaaaaacccgcaaagataatgaagatatttatcgttagcttgggcaatttgtgctaaactttgtgccgttttgttgaataaacttttctcatagaatcagggaataaaatgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagccggggatttatttttggggcgcctgttgctttggcgttaaatgttccctttattttggtacgcaaaccgggcaaattacctcgtgaaactatcgcacaatcttaccagttggaatatgggcaagataccttagaaatgcatgtaagttctattcaagccggtgataatgtacttgtgattgatgatttattagcaactggtggaactattgaagcgactgtaaaactggtagagcgtttacaaggtcaagttaagcatgccgcttttgttattagtttgccggatctcggtggtgaggttcgtttacgtgaacttggtgtggagccatttactttagtcgaattttcaggtcattaatttcttcaaattaatagagatagataggcaatgagttatcaagtattagcaaggaaatggcgtcctaaaactttttctgaggttgtgggtcaagagcatattttgaccgcactttctaatgggttatgcgaaaatcgcttgcaccatgcctatttgttttctggcactagaggcgttggaaaaacttctattgcacgtttatttgccaaaggtctgaattgtattaggggggttacggcagaaccttgtggtgaatgtgaacattgcaaggctattgaggaaggtcgttttattgatttaattgaaattgatgctgcttcacgaactaaagtagaagacaccagagagttgcttgataacgtgcaatataagcctactcaaggtcgctataaagtttatctgatagatgaagtgcatatgctttctcgtcattcttttaatgcgttgttgaagacgctggaagaaccgcctgaatacgtaaaatttttattggcaacaacagatccgcaaaagttaccgattacgatcctctcacgttgcatgcaatttcatctaaaagctttatcagaaaaacaaattgcacagcatttagaatttattttacaacaagaaaatattccttttgaatatcctgctttggaaaaattggcaacagctgcacaaggtagtattcgagacagtttaagtttaactgaccaagctattgctatgggcaacgctaatgtaagtttggatacagtaagtatcatgctgggcttattggatgacaatcagcctattgatattttatatgcgttacagcaaggcaatggtgaaatgttaatgaagtcaattcaagctgtagcggaaaaaggtgctgattgggataagttactggtaactttagcggaaaaattgcatcaaattgccatgctacaacttctgccacagcaaataaatgaagaaaactcgcttggatttttagctaaacatattacgccggaagatgtacagtttttttatcaggttattgttagtgggcgtaaagaattagcatctgcccccaatcatcgtattggtgccgagatgattttgttgcgatccttagcgtttcaccctaagttcattagtccttcttcagcagcaccaatagaacaaagtgcggtgcaaaaatcacaaaatattgttcaaccgtctttagttgagatgcccgttgtttctgttgccgagcaattaccttcgcaaaatctcattcgtaaaccaacgatagcagataaggtcgatactaagttaagtacaacagctttaagtgctttagaagcgttagaacagttgtcacaacctagtgatcattcagatagcgaaaaaaaaaactcgccgatagataatattcatgatatttctttaagagaaaacactgaaaatatctccgcacttcctgttctaaatgttgtgcctaaagatgttgataatgcacttaagacggttactgtcattgataagagtgatcatagaagtgatgaaattcaagaggatagtgctgagaattatcgttgggaatggcgaaatccggaaatggcggttgaggaaaaggctattcgtccttctgaaataaagcaagctattttagaacaagcttctccggagctcatacaacgtataattgctacggcacaagaaagagatgattggactcggatcattgagcaattacctttgagaggtatgacaaaagacatggcgttaaataccgttctattaaatcaatcgggggatcagatcgttttatccttaatgtctgataaacagcatttgttagatcgttgtcataaagaattaaagcaagcattatcggatttctatcaacgtgatattcagttattaatcacacctactgacgataaaaatttagccactcctttatattatcaaaacttagtttatcaagagtttaatgagcaagctaaaaaagcgttacaagaagataacagcctaaaattattagaaaaagaatttgccgctacgctggatttggatagtgttagaccgatttgacatttttactacgatttagatattgtcttgagctttgagcaatgattatataatgatgaaaaaagctaaaaatcgactgcactttttctttatttgcgatccggatcgcataaatgttttttgatgacaaattctcttttcccaaatacaagaaaattgctagattaatcctattgaacaaagtacaatctccgcctctttttgatcatcaatgaatgccataaggtgtaataacggggcaataaataataaatgtcggacaaaattaatttaatgaatttaactcgtcagcaaatgcgagcattttttcaggagttaggtgaaaaaccttttcgagcagatcagttagttaaatggatttatcattttggtgaagataatttcgatcatatgactaacattaataaaaaattacgtgaaaaattaaaaactgttgctgaaattaaagctccggaaattgcagttgagcaacgttcagctgacggtacgatcaaatgggcaatgcaagtaggagatcagcaggtagaaaccgtttatattcccgaaacggatcgtgctacgttatgtgtatcttcacaagtagggtgtgcattagcttgtactttttgttcaacggctcaacaaggttttaaccgcaatttaactgtatctgaaattattggacaggtttggcgagcttcaaaaattatcggtaatttcggtgttactggtgttcgtcctattacaaatgtggtcttgatgggaatgggagagccattattgaatgtggctaacgttgtaccagcaatggaaattatgttggacgattttgcttatggtttatctaagcgtcgagtgactttatccacttccggtgttgttccggcactagacaaactgagtgaaatgattgatgtggcattggctatttctttgcatgcaccgaatgatgaattgcgtaatgaaatcgtgcctattaataaaaaatataatattaaaatgttgatggagagtgttaatcgctatttaaatgtttcaaatgcaaatcacggtaaggtaaccattgagtatgttatgttagatcatattaacgatgggactgaacatgcacatcaattagcagaggttttgaaaaatacaccgtgcaaaattaatttaattccttggaacccgtttccggatgcaccttatgctaaaagctcaaatacacgtatagatcgttttcaaaaaactttgatggagtatggttttacagttattttacgcaaaacaagaggtgatgatattgatgcggcatgtggtcaacttgctggtgatgtgatagatagaacaaagcgtacggcacagaaaaaacggtttggaaaagaaatcggcactcatcaaatttattaactatttttaatgtataaggagagaaaactaatgcgatatcggactatatttacttttattatattctctctttttctttctgcttgcgtttctcagcctacaactggtcgctttaataagcaacaagctgcaaaagcacgaattgagttaggtttaggttatttaaaattacgcaatttttctcaagcaaaacttaattttgataaagctttattctatcaacctgactattatttggtacattcggcttttgcctatttatatcaattacaaggtgatatttcgcaagcgaaatcctcttatgaaaaagccatcagtttggataagtcgcaaggtgatgtgaaaaataattatggtgcatttttatgtagtcagggcgaatttgctcgtgcttatgagttatttgagcaggcacttattacgcctaattattatcagcaagcggatacctatgcaaatatcatcatttgtgcagaggcggaacataatattccacgttatcagaaatttttacagttactgaagaatattgatcccaaaagagcggaggaaataaagaaagtttcttagcttagttagcgtgagttgaaagatcaaaaatggcaagactgtcttcttgccatttttattatattatgattttttgatgtaattagattttacaagctcctcctgcacaagcgtcatcaagatcttcttgcatatcttctgcaccatctctagtgttttgataatacagggtttttaatccatatttgtaggcagttagtaaatcttttaataaaaccttcattggtactttaccatcttcaaaacgttttggatcatagttagtattcgctgaaattgcttggtcaatgaatttttgcatgataccaactaagtgtaggtatccatcattacttggaatatcccacagtaactcatagttttcacctaaattctcataatcaggaacaacttgctttaaaattccatcttttgacgctttaatactaacatgtccacggggaggctcaattccattggttgcattagaaatttgagaagaggtttctgatggcattaatgcagttaatgttgaattacgtaaaccaaattcttgaatttctttacgcaaggcttcccaatcgtaatgtaaaggctcttttgttaagttatcaatatcttttttgtaagtgtcaataggtaagatcccttgtgcataagtggtttcatggaagtattcgcaagcaccgatttcttttgccaaattcattgaagcttttaataagtaatattgaatagcttcgaaagtgcggtgtgttaaatcattcgctgaaccatcggagtaacgaacattattttttgctaaataataagcatagttgataacaccgataccaagagagcgacgagctaatgaactgcgttttgctgcagcaacagggtagtcttgatagtctaatagggcatctaatgctctgactgcaagatcggctaattcttccaactcgtctaaattttcaagagcacctaagttaaatgcagataatgtgcatagtgcaatttcaccgttttcatcatggaaatgttgcaacggtttggttggcaaggcaatttccaagcataaattagattggcgaattggtgcaaccgcaggatcaaatggcgaatgtgtgttgcaatgatccacattttgaatataaatacgaccggttgacgctcgttcttgcattaataaagaaaatagctcaacggctttgacactgcgtttacgaacagcgggatcttgttcatatttgagataaagcgtttcaaatttattttggtcagcaaaaaatgcttcgtataaccctggaacatctgatgggctaaatagagtaatttcaccccctttaattaagcgttgatacatgagcttattgagttgaactccatagtccatatggcgaacacgattgtcttcaacccctcggttattttttaataccaataaactttcaacttctaagtgccaaattggataatagacagttgccgctcctccacgaacaccaccttgtgagcaagattttaccgcagtttggaaatgtttatagaatggaatgcaaccggtatggaatgcttctccattacgaatcggactgcctaaagcacgaatagcaccggcattaactccaatgcctgcacgttgagaaacgtatttcacgatggctgatgctgttgcattgattgagtcaagactatcaccgcactcaatcagtacacaagaactgaactgacgagtcggggtacgcacacctgccataattggcgtaggcaaagagattttaaaggttgacgtagcatcatagaagcgatgaatgtagtccagacgagtttcttttggatatcttgaaaagagacttgcagcgactaacaaatataagaattgtgcagactcatagatttcacctgttactctattttgtacaagatattttccttccagttgtttcacagcagcataggagaatgtcatatcacgccagtgatcaaggaaaccatccatttcatcccattcttcacgtgtataatctgttaataacgcctgatcatattttcccatccgcacaagtttttttacatgatcataaagttttggcggctcgaaatgtccataggcttttttacgtaaatggaacactgctaaacgagcagctaaatattgatagtcaggactatctttactgataagatctgcggcggctttaataatagtttcatggatatccgaagtgcgaattccttcataaaattgaatatgcgattttaattcgactaaggaaacagaaacattttccagtccttccgccgcccaagtaatgactctgtggattttatctaaatcaataggttctttgtttccgtcacgttttgtgaccatcaatgctttattcataggatttccgagaggttctgatatggttaaaacacaagatatagttataaatcaaaaatgaactacaagataatgggttggacggaaaaattcaagtaataaatttcatctatgattcttgacagaaaataacttacttataaataagtaaaaaatgaaaaagtaataaaaactattatcaaaaattgtgctgtagatcaaaatttatattttttgatataaataaaatgatctttattctttgtggcaataaaaaagccgttcaaagaacagctttcaagggttattttcctaaattatcaaagaatttttttacaccatctaaaaaacctgaggatttagggcgttggagcgttttaccttctaaactttcttccaattttcttagtaactctttttgttcttcgtttagtttaattggtgtttcaataacgatctcgcagattaaatcgccagcatagccgcgagaggtaatgccttttcctcttagacgaagcagtttaccggtttgtgtttcagcaggaattttaactttaagacgaccgtctaaagttggaatttctatttcgccacctaatgcagccatagtaaagctgatagggacttcacaataaagattgttaccatcacgttcaaaaatatggtgtttttttacatgaataactacatataaatcaccggcaggtgcaccatttttacccgctgctcctttacctgctaaacgtaattgattacctgtatctacgcccattggaatggtaacggtaagattttgggttttatgaactctaccttcaccgtgacaggtatgacaaggtttctctatttttttgccagtaccgtgacagtgtggacaagtttgttctgtaacaaagaaactttgttggcgacgaacacgacctgcaccatgacaggttggacaagattcaatttttgaacccgcttccgcccctgagccatgacaagttccacagtgaacaagggtgttaatttgaatatcttttttacagccttttaccgcttcttccaaacttatttcaatatcgtagcgtaaatcctcaccacgaacaacacgttgacgagaacgtccgccaccaaaaatatcgccgaacatatcgccgaaaatatcaccaaagtcagctccgctaaagccgccgaaaccgccggcaccaccaccttgttcaaaagcggcatgaccatattggtcatacattgcccttttctctttatcagccaaaacttcgtatgcttcattaatttctttgaatttttcttcgctttctttatcacctttagttcgatccgggtgatatttcatcgcaaggcgtttgtaagcacgtttgatttctttatcatctgctcctttttgaacacctaatatttcataataatctcgttttgccatgtgtaatccggttagttgttgcgttataaacgctgatagtcatacgttgaaagggcgtattactacgcccttgactctgattagtgagatatacagattatttatcttttacttcttcaaattcagcatcaacaacatcatctccacctttcgtactttgagattgttgtgcaccggcatcagcttgtgcttgttgttgacttgcttgaagtagtttttcggaaacttgaattaatgcttgtacttttgcatcaatttcagttttatcttcaccttttgccgcagtttcaagttcattgaccgcactttcaattggtgctttgtcttcagctgataatttctctccaacttctgctaattgtttgcgggtactatgtactaagtgatccgcttggttacgagcttgaactaactcttcaaatttacgatccgcttctgcattagcttccgcatcacgaaccatttgttgaatttcttcatcacttaaacctgaagatgctttaatcgtgattttttgttctttaccagtacctttatcttttgctgaaacatggataataccatctgcatcaatatcaaaggttacttcaatttgaggcatgccacgtggtgcagggttaataccttcaagattaaattgacctaaagacttattggcagaggcttgtttacgttccccttgaagtacgtgaatagtcaccgcactttgattatcttcagcggttgaaaatacttgcgattttttcgtcggaattgttgtatttttctcaatcaaagttgtcatcacgccacccattgtttcaataccgagtgataatggtgttacgtctaacaataaaacatctttaacatcaccggctaaaacaccgccttgtacagctgcaccaatagcaaccgcttcatctgggttaacgtctctgcgaggctctttaccaaagaattcagctactttctgttgtactaacggcatacgggtttgtccgcccactaaaataacatcattgatttcggaaacacttaaacctgcatcggaaagtgcaactttcacaggctccattgaacgtgcaactaaatcttccactaacgcttctaatttcgcacgagtcaatttaatgtttaaatgtttaggtccagtagcatcagcagtgatataaggtaaattgacatcagtttgttgagcggaagaaagctcaatttttgctttttcaccagcttcttttaaacgttgcattgcaagtggatcgttacgtaaatctacaccttgttcttttttgaactcatcaactaggtagttaattacacggttgtcaaagtcttccccccctaggtgagtatctccgtttgttgctaaaacttcaaacgttttttcgccaccgacttcatcgatttcgataatagataagtcaaatgtaccaccacccaagtcataaacggcaattgtttggttgcctttacctttatctaaaccataagcaagagccgccgctgtcggttcgttaataatacgtttgacttcaagaccggcaatacgtccggcatcttttgttgcttggcgttgtgcgtcattaaaataagccggcactgtgattacagcttctgttactgtttcacctaaaaaatcttccgcagtttttttcatttttttcaacacttcagctgaaatttgcggaggtgccattttttcaccttttactgatacccaagcgtcgccgttatcggctttagtgatttcaaaaggcataatagcaacgtcacgttgtacttcttgatcttcaaagcgacggccaattaaacgtttgatcgcaaataatgtatttttcgggttcgtcacagcctgacgtttcgctggttgtcctactaaggtttcattatcatttgtataagcaataatggatggggttgtgcgttcgccttcagcgttttcaatgacacgtggtttgtcgccgtccattacagccacacaagagtttgttgttcctaagtcaataccaataatttttcccataatatgttttctcctagtatctagtataaattcgttgacagtttcaagattgggataatgattgcaatttcaagtgcatggaatgcaaaattttgaaagtgcggtcattttttgccttgttccgtaaaatgtgattggaaatgaaaaattcaagaggaaaaatgaaattttatgtaaattaagttaaattttgttcaataaattgttgtttttttatttgaatcgcaatttctctccgacgatccagttctgctcgaattgctttatgttgaaagccttctgaaataatctgttgcacatcaacagctaaagctgcttggtagaggcacaacaaaaatttgtattgtgggcaatcggtatagttcatttcggtttgagtaagactatcagcaaggcaaactaacattaattcttcgaagcgttttggtttacgccagacatctaacttattaaataacgttaagattgttttggtgtgcaatgccaaagcatgatgaatatgagaatgatattggcaagttaattctgccagttcttgaacatagttagggactttaaaacgctgacagacatttctgagataagcaatacgtgttattttattatcatgagaataggggggaatattggcggttgagagagcttttcccacatcatgacaaagtgcagcaaaacgtaccgcacttttgtgataatccgttttttcggttaacaatgttgtttgcttaagaatgggcatagcatgcacaaaatcagtcatgtcggagcgatattgtatagagtcggaattaaacacactaatttccggacataaaacttttagggcatctattttttgtaagatagcaaaataaacttgtggatcctgttcatgtagtgctttttctgtttcttgccacactctttccggagaaagttgtctcaactctccattattggctatttttttcattaaggctagcgtatctggtgcaattttaaagcctaattgatgataacgggcggcaaagcgagctactctgagaactcgtaagggatcttctgcaaaagccggcgaaatatgacgtaaaataccttttttcaaatcggcaataccattgtatggatcatgatattgccccgccatatcctgagcaatggcattaatggttaaatcacgacgcatcagatcttgttctaatgtaatattagggttgaaatcacaaataaaaccggtatagccggtacctgatttccgttctgttcgtgcaagtgcatattcttctcttgttttaggatttaagaaaacaggaaagtctttaccaacttgttgataaccctgagagagtaattcttcagctgttgacccaaccacaagccaatcacgatctttaataggtaagccaagtaattgatctcgaacagcaccgccaacaagataaatttgcatcatatcgttaagaccaacgattttggcgacggcgtttcggtattagtagaggtaaaataagaccaagcaataatcctgcacctaaaacagagccaccgtagataaaccactgaatagcgatttctcgtttacccacatctaacatcgcttctaaatcacgatttttattttttgtaatttccaattccctattaaggagtgagttttgttccagtaatttgctgctttgttcttctgcttgtttggtacggcgttgcatctcgcttgttcgttgtttccagtcattgtcaatattattgagttttagagttaactcttggatttgagcttttaattttggattttcttccctactacttggagtactggttaattcacttgttaaaatccatgcttcacgattacgtttgtcacgaattaaggaatatttatcttttttatccagtacggtaaccgactcgcctgcttgaatagttcccgaaattttaaattgatctcctgcacctcgtcgcataaacgttgtgagattttctttcacgtattttgtttcggcataagcgttggataaggaaaatactaatagaagagcggatactaaaagagaggtaatttttttcataataaatccagaaaataaggtcaacaaaaaagtaataaaaagtgcggtagattttaccgcacttttttttgctgacaagtaatgatttattttatctttgagcgttaatgaaaaatcgcataaataatgtaataaatcacaatagcaaagaaagtacccgcaggtaatgtaacaatccaagaagcaacaatattacgaataacggttaagttaattgctgcaataccacgtgcaaaaccaatacctaaaatagcaccaacaagtgtttgagtcgttgatataggtaatccggttcctgatgctaagacaactgttacagcagtggcaaattgggcagcgaaaccacgacttggcgtgaggtctgtaatgcctgtcccgatcgttgacattactttataacccataacaattaaacctactccaatgccgacagagccaagaggcaggatccaccaagccagggtggtttttcctgcaatctcaccaccatgttctatgatggaaacaacggcggacaaaggaccaactgcgttggcaacgtcatttgaaccatgagcaaaagccattgcacaggcagttaatagcattaaaatactaaatactttttcaactgctccaaaggttcctttcgtaacattttgaatgaaacgttggctacgaaaataaaaagaaccaagaatacccgcaataatactaatgataccggatataatcagtgtttctatggtagttaaatgtaatccaatatgttttagccctttcgtcatagttacaatagctaaaataagaacggtcagtcccatataaaaaggtccgtatttttgggcattagctaaaggttttggcgtgtcaaagattaacttttgtgtactaaagaaaatagcgtaagcaataattccggcgagaataggggtgataaaccaacttcccacaatattgcgtacagttccccaatcaactgcatgtgcaccgacagtaatacaagcaaaaccgacaattgcaccgataattgcatgagttgtagaaaccggccaacccatttttgaggcaattaataaccaaatccccgatgaaaaaagagctgccatcataccgaaaaccaaaatttccggagtatcagtaaactgcattggatctataacgccgcttttaatcgtttctgttacttctcctcctgcgaggtaagctcccgcacattcaaaaaacatcgcaataaaaattgcttgttttgctgtaatagtacctgaacctactgatgtccccatggcatttgctacatcattagcacccacaccaaatgccatcaaaaaaccgaaaacggcggtaataataacaagtatagttccgtattcttgtaaaatttccatagttgatcactcctatgtatttatcgttatgaacgagctaacattaattcaattcgtgaacccacacgttgtgcttgatcagctaaaaccccaatccatgctaaagtttcatataaaaacatcacatcaataggactgtactgattttctatgtttcggagcatcatacgaagtttgatttgcatatgatctgtatcatcttcaatggcatccaactcatggattaggttattgacgagagtcagttcatgtcctttaaatccggtttccaataacgcatccatttcctcaatcacacgatttgcttgaactgtcgcatctaaactacgataaacatatttcataaaatcctcttgcatttcttgaggaaaggtaaattggcgaccgagcattctcccagctatatctttggcacaattcgctaatttatcttgttgagttgtcaactctaataaatctgtacgatcaattggcataaaaagacctaaagggagcttcaagcgaatttcacgtttcagtgtgtcggcttgacgttcaagttctgagagctcagcacggatttttgttgcattatgccaatctccggcaaaggtactttcaaagaaaggaatgagtagtttacaacattcagttactttatcagaatgacgctgtaatggcgttagaggtgaatgggcaaataatcctagaatattattcattgccatatgaattgaactccttagtggatttgataaaaaattcaggcgcatattaccttatgcgaacagaaaaatatagaaatttcatcgaaaaaaataggtttttagtagataatacaggaacgcatttcttagcaaggaaaggaaaatgaccaaagaaatagagcttaaattgagtgtatcaaatgcctttgctcaatttttaagtcaagaaatgacaagttttcatgtgttaaaacaagagaaggtttttttaggcaatacctattatgatacagcggacagttattttgctcggcacaaaatgggcttgcgtgttcgtcaatataataatgattttactttaaccttgaaaacaaacggtgatgtgctgggtgggttacattctcgccctgaatacaatgtatctcaagaaagtgcggtgccaaatttggcgaaattaacagaaatatatgacttaccgaattggcatgaatttgtcttacagcctattttccgcactgattttgagcgttgtttatggttggtagaatgtgggtatgatgtggaaattgaagtggctttagatcaaggctggattattgcaggagaaaaatccgttcctatttgtgaagtggaatttgaattaaagcagggaaaaacagaggatttgttaaattttgtggcaaatttatctttagaaagtgatgttcgcttaagttcagccagcaaggcacagcgaggttaccaattggcatttaatatacaacctcaaattcaggattggatcgcaaaatggcgtgagtttattgtcttagcagcacatgaaaagatcgcttatttagtaaaatttgaacagcaattaatcgaagaaagtgtgatgctgggaaaagattattttgcacaagaatttttgcgtacagtggagcgaatcggtgcattttttaatctatatcacttttatagtgagaacgtaacgttattggaaaatcaagtaaatcttcaattgacgcaaggcatcactcatttggatcagaatttgcttgctgatcttgttgaacgtaatgcttatttattgttgcaaattaaagacattattcggtgtcatagtgaaaataaaaataatgcacttgcgattgaaaaattatttgcattatttcatagcggtcagtatgtcaaacgtatgttagatttaacgtttttaacactttaaggatacagcatggcaaaatcacccaaaacagcctacgtgtgtaatgactgcggtgcggagtttgcccgttggcaaggacagtgttctgcatgtaaagcatggaatacgattagcgaagtgcggttagtttctacagcaaaagtgaaaaatgatcgttttagcggatatgcaggagaagcgaaagccaaaattcaaactttagctgaaatcagtttgcaagaaacgcctcgttttaccagtggttttagagaattagatcgtgtattggggggcggaattgtgccgggtagtgcgattttaatcggtgggcatcccggtgcaggaaaaagtaccctactgttacaagtgatgtgcggacttgctcaaagtatgaccgcactttatatcacgggcgaagaaagccttcaacaagttgctatgcgagctaatcgtttaggattgccaacggatcgtttgcaactcctatctgaaacctcaattgaacaaatttgtcatcttgctgatcaactaaagccgcaaattatcgttattgactctattcaggtaatgcatttatctgatattcaatcttcccccggaagtgtagctcaagtgcgtgaatgtgcggcatttttgacccgttatgctaagacaaggcaagttgccattatcatggttggtcatgtaacgaaagacggaacgttggcagggccaaaggtattagaacatgcaattgatgcatctttattgttagaaggtgaatccgattcacgctatcgcactttgcgtagtcataagaatcgttttggtgcggtgaatgaattgggtgtttttgcgatgacagagcaaggtttgagagaggttaaaaatccttctgcgatttttttaagtcgtggtgatgaacaaacgtcaggaagttccgtgatggtagtatgggaaggaactcgtcctttattggttgaaattcaagcacttgtcgatcattccatgttagccaatccaagacgtgttgcagtaggtttagaacataatcgattagcattgcttctagcggtattacatcgtcatggcggtttacaaatgtccgatcaagatatttttgttaatgttgttggcggggtaaaagtaacggaaaccagtgccgatcttgccttattgctggcattaatttccagctttcgtaatcgacctttgccacaagatttagtcgtgttcggcgaggtaggtttagcaggggaaattcgccctgtaccaagtggacaggaacgtattagtgaagcagcaaagcacggttttaagcgagctattgttccctttgcaaataaaccgaaaagtgcggtcgaaaatatgcaagtttttacagtcaagaaattagcggatgcattggcgatattagataatttttaacaaaattgccggataaaaacgaataaatatctaaaaaatagtgtaaaattagacaaaaataaatattttatgcggaatttctatataaaaagggatgaataatggaaaagaagattaaatcacttgatagtattgatataaaaattcttaatgaattacaacgcaacggaaaaatttctaatattgatttatccaaaaaagtgggattatcgccgacgccttgtttggagcgggtaaaacgtttagaacgccaaggcattattatggggtatcgtgctttattaaaccctgaattattggattcgcctttgttggttattgtggaaattacattagttcgtggtcgccccgacgtgtttgaggaatttaatgtggcagtgcaacaattagatgaaattcaggaatgtcacttggtttccggagattttgattatttgttgaaaactcgtgtagcggatatggcagcgtatcgcaaattgctcggcacaactttattacgtttaccgggggtaaatgacacacggacttatgtagtgatggaagaagttaaacaaactaattttttacaattgaaataagatgattaaacgtattaaacaattttttttaccgaaaagggatttagtcgagtttttattaattctcaccgcactttggggcttttatttgatcgttgcttggtttagctatagcccgtttgataattcgtgggcgatatcttcttttcaaacggaaactattaataaagcaggtgcattgggtgcttggatgattgatctgtttttcacgttttttggcgttgtaggtaatatcataccgtttgtactatttatcgcacctatttattttttacatactaagcgaactcaagggttaacttggggaagattttttcttcggatattgggttttgtgacattgctggttggtttaatgatcttggctactttaatgttggtaaaaactgaacatcatttatcgggcggtgtattaggtgctattttaatcgttaagttatatccgctattttctaaccaatttcccttaattattattggtagcattgcttctataatcggttttattttctgttcgggggcatctttattttatttaatgatgaattgttacgactggctgacaatgaaagataaagaatctctattggatacacaatcgaatggtgctgattcagttgaacaggaattggaagaaattatcatacaatcgccacctatagaacaaaatatcgccaatgaagatactgaaaaacaaggacttgagttagtgaatattagtagttttattaatattcaagggttacctgatgagcaagtggaagaacagcaaaatttagcagctccgatgttgatgaagcaaaatgaagtggttgatattgctcaaacactaggcgatttaaagcaacaagaattgcctattccaagcgtttcattgtcaacagaaaaaaatgaagcgttagctttggaaacagaaaatattgcagaacagaccgcactttctgccgttgaggaagctgacaatcacaatataaatgaacttgccaaacaatttgctgaatttgagcaacaacgtttattgaaaatggaacaacaggcaagagaaatcggagcagaggatgcgttaaaagtgattttagctgaagaagttactgaagacgtgccggcggttatggaagaagttattgaagaaaaagaactcagtcaaagtgcggttaattataagacttatggcgatagtttgattcaccccgcattacagcagaaagtgactgttcaggaaaaaccgacaacaccattgccaagtttagatttacttgaacgccgaacgatccaaacttataacattacccaagaggaaattttagaaacatctcaacgtattatgcaacagttacgtaattttaatgtaaaagcggaagtgcgtgatgtactcgttggtcctgtggtaacacgttatgaattagaattacagccgggagtaaaagcttcaaaagtgacaagtattgatactgatttggcaagggctttaatgtttcgttcaattcgtattgccgaagtgattccgggaaaaccttatattggaattgaaacaccgaatatacagcgtcaaattgtacctttgcgtgatgtattggatacggatgagtttcggcaatcaaattatttattaccaatggcgttaggcaaggatattagcggtaagcctgtgattgtagatttagcgaaaatgccacatttattagttgcaggatctaccggttcgggtaagtctgtcggtgtgaataccatgattttaagtttacttttccgtgttaaaccggaagaggttaaatttattatgattgatcctaaagtagtggaattatctgtctataacggcattcctcatttacttacggaggttgttacggatatgaaaaaagcagctaatgccttgcgttggtgtgttgacgaaatggaacgtcgctaccaattgttatcagccttaagagtgcgtaatattgaaggatataacgaaaaaattacagaatatgaagcgttaaatatgccaattccaaatccactttggagaccgggtgatacgatggacactttacccccaccattggaaaaattaagttatatcgtacttattgttgatgaatttgcagacttaatgatggttgcgggtaaacaggttgaagaacttattgctcgtctagcacaaaaagcacgagctattggtattcatctgattttggctacacaacgtccatcagtagatgtgattactggtttaattaaagccaatattccaagtcgtattgcttttactgtagcgagtaaaattgattcaagaaccattttggatcaaggtggtgcagaggcattattaggacgtggtgatatgctgtattctgcacaaggatcatctgagttgttacgtgtacatggtgcttttatgagcgatgatgaagttgtacgtgttgctgatgattggcgtgctagaggcaaaccgagttatattgaaggtattttggacagtgtgaatgacgaaagtaatgataatgaaactgactatgacagcaatggtgatctggatgatctatttgatgaagttgtggaatttgtcataaacaccggcatcacatcggcatcttcagttcaacgtcgtttccgtgttggatttaatcgagctgctcgtatcatggatcaactggaagaacaaggtatcgtttctccgctacaaaatggtaagcgggaagtattagcgaggaaaggggattactaaattaacattgcgatataatttgtgcaaaaaaccaccgcacttaattagtgcggtggttttttctttgggtgtagcaagttggctaaattaccactgataccccacaccaaccgaaccgccgacatcgcccgttgaactgcgagtaccttgcaatcgtagcgttattttaccattatcacttactcgtgaataacctaacgccagtgcattttgtcctttaaatgttccggcagatgccgcaaacatggatttacccggcacagaagacatcggcaacccagccgccgccaacgctcctgcaattcctgcacgtaaatttcggtcagtagtattcaattgtgtccgcagttcattgtctttggtgtccacatagtttttattagcaattgccatacctgaactggaagtgttcaaatcggaaaccaatgcttcacctttggcatttatgctgattaccgatttttcacccagtcttaacgcacgagacttgccgtctaaattcagtcctaacttatcattttcatagaacgccaagcgattttcgtttaattgggatcgctcttttgtacttgtgttttccacattcaacccattgctatccaagcgagattttttgccattgatttcacgggtttcaaaagaggtcatgtttttcaattggtcggacagtttgacttctaagcctttaccgtcttgagacatttccactttgatattaccggcagcggtgcggtcgctgttaaatttattgccattcgcaccttcttcacctttaatcgccaaagtaccgcttaatgctgtgcgaatttccatgtcatcattgcctttaaatttcaagcccgatttcgccaccgcctgcaaatcaccgattgttgccacgttggttaactctgcggaactatcaggtttcactaactctacaactttctcatagcctttgtaattttgttcataggcttcctccgcttttgttaagcctgtttgagcttcttttaaatcatttcttgcttgttcaagtgcttttttcgcttcatcaagtttcatttgattttctttgagcttggcttctgcttgtgttttatcattgccttctggcaacgcatttattgcttgttctaagctacttaccgctaatgctaaatccgtgaaagtttgtgctttgtccgaaagtgctttagcttcctygcycacygctttyactttttcctcaacagctttggtgagttcagycgmtttttcttgagtctttttcttctcttcttcggtttgtgcttctarsccaagaccactygccacattgctaatcccaatmggygyggygstnggttcggctttgatcacgacttttttcttctcttcctcagaaatatcttgaagtgtgccgtcttttaattttttgaaactaccgtcttttcctttcacgactttttccttgcctaaataaaaatcaaatggacggttattgttcagatttttaacctgttcatcgacatagtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggttttgcccctgctttaatagtgattgatgctgtatcagcaaatggatttgctccatttgctccgcctgtgttattcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagctttaccgtcttcaagtttcaatgcccccttgccatcagctttgttaatttcagacacgccactgaatttaccatcggctagggtaacctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttaaggtctcgccgagttttctggtgacatcttgagcgtcatttccttggaacttcagccctttttccacaatcgctttcgccacttcggataagtcttttacattaatggcattgttggaaattttgttgccgttgttattacctttatcaggattgccagtaagaacgttggcaataactgtactattattttcggcatttccaccagtaccgctagtatctgtcaatcctaaaccgctcgcaagtgcggtgatttttttattaccaacatggaatccttttggatcaaaggtgtagctcgcaccatttgaaagaatgacaacattggtattcgcattattgcctttactattttcattaaacttaatttcagtttttacttttgtgccaccattaccgccattggcgacctccttaccggcaatcgaagcaatctcttttaatgcctcattgacattaaacttaacaacaccgttactttccactacagcggttgtgtttgtaccatctttaaaattcaaaccatcgcttaatttgacggtataatcacccgaaccattcgccttgtatttaatgacttggtcggtaatttttccctctatactggtttttactgctgtaatagctttctcgtttttatccgctttagtagccgtatcatcaatttttttcgtgattttctcatctagcccaattttgatcgtatcttcaccctcaacagaggttttaatttgattagcagtgcctttcactttcaaagtacccgtttttaatggwaaggttttttcaccaccactgtctgcttggaattttaagttagagctgagattattaactttatcatcaacatattttttagtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaattttatcaatattatcatctatcgcttgtttaaatgttttttgtatagctggtgttgaagcagtggctccgttagaacctattaattgattgaatgttgatttcgtaaatccacctgaatttactgtcgcacccaatacagttgttgctaactcttgtaattgtccaaagttggcagcatctttgtcggctattccttttgctaactgggtaatttttttgttgcctaagtccaagccatctctttttaatgttatcgttgaaccgctttttgacgagagtttaagaccatcactgttcgtaaagtcaattttattgccactattgccatttttaccggcaatagaagaaatacctgttaaagtgtctttaagcgatatggtaaccgcactaccgctagcgtttgtcttgatattgccattatctcctttaatatccagtttgctagttactttaaaggttccgttatccccatttacattaaaactggtagcaacatttttgaatttatcatcaacgtattttttgttgacggcatgcttgtcatctgtagggttaccggtaagttttacagtcttaaattcaggatcgtcttttaagccgatagtaaatgttggttttgaactatcgtttttaaattctgtttttaggtttttacccagatgtgtgtctttaccgccggattgaatatttccagctttgattacaatggttgaacctaaataaaaaggtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccaatatattcaacagcggtaaaattatgactattaaattctgttttagcattgttagccgtcaaccctaagatactaccaccaagctgattcagctgattccctgtaatcgcttgatccgagttttgtgcaattttgccgtcttttaaattgccgaattgtattttgttcccaagatctttggygcctattttttcatcgaaaccttttgctccgactaatactttgtcctcggaaattgcctgagaatcttttaacggttcgcctgtttgggtatcgactttgtagaattttttgtcatcagccgattttactagcttcactttcttgccgccttcttcggtgtagtaaacaacaagtccttcttttttaacataatataacgctcttagttgtcctacagtggcggcatcactatccaacgcgcccggtgcgacattcactattctacgcaatccaacatgatttttatttcctttagatgaaccgggaccgccctttgcatcttttgttgtatcccaacccccaacggaaataacccctgccgatgtatccgtttcaattctataactggaaccttccggtacatatccttctaaattggaggcattgtaggcatttttttcatttaaactggctgttgttttatctgtatcagtataaaagtaattcgtcgttgatctatatcctaaggcgactgaattttcggatgatgagcttgaattattccccaatgcgactgagtttttagcattttcattaatcttagaatcattccctagtgccatagaggattctgaaagagaagacgaaccatatcctatggcaattgaattatctttcttaatcccaactccggatcctatcccaattgctctcgcacctatgacggttacccccgttcctattgcaaccgagttttctttatgtacgtttgttcccacacctatggctattgtattggttgcatattttccaacattatttaacgcccctaagacgaccgaattagctccccttacataagaggcactacctatggctatggtattatctccattatttgaaatgtgataacccaaggatattgcatgatctccttgttttttcgttttctttatatcttctgttgtggtgatttctacatgattttctttttcatatgtaaatttattttctttttcaagtttagttatcaagtcgcttattttattctgtccattaaaatgattggcaggaaatccatacttaacaatttcattgtgatctcccactttaagatcattaatatcagtagttacagttttcaaccaaggatcttgattttcagtcacattaccaaggttggtttcttgcataatttgagctctgaatttctcagctgatgtatgcgttaattctgcattcgaagacacattaggtcctatcgctattgaacccattcccactgcttttgctccggaaccaaaggataatgatccttctgcggttgattcagccgcatttcctatggcataagaatttttcgcaaaaacccttgatgagtcacctattgctgttgctccgtcagcacctaaaccgacaaacgcacgaacaccgaccgccgttgctctatcggctaatgcaaatgataacgtccccatagccagtgaagcatttccatatccaactgatcttgaccctattgcgattgcccccactccggctgcataggttggggaatatattctgtgatcttcaccagaatctgacctaatatattttttgtaaaactcgctctcatttactaaatccttataagtaacgttactagatgcgctatttccattatatccataaattagttttatagtctcttcaggtagcctatcttcaaatcccccaagtcctgctttaatattatttgctccaaaggtaccttttttcccatttgcaaatatatcatcactacctattgcgatagatgattctccagccgccatgacgtccgcacctaaggctgtcccttgtgctgctgcataaacattatttcctattgccgttgcttgagcactttgagctttacttcctttccctacagctgttccatyttctcctgctactgcagcttcatagcctacggctgttgctccatctcgaagtgcttgagctccgtatcctacagcaaccagtccttctcctgttgctttagttttatctcctgcccctattactacaactttttccaacttggtgacttgtccacttactctatgtaggtcttttttccctaacacaatattaccattattattattttctccatattcattgcgccaacttgctatacctacagttcctttactttcattaatagctaaccaagcagcatttgatatagtactcacccctaaaaagcctgctatcataaaagccaacggtaaaaccttaaacgttcgtaaaagcccaccgcactttggtttctccgagctgctcgccacttggcgattgcttgccaactcggaaacggctttacattgacctgttgtaatatcgtatttggttttaaatattttgttcatagaattactcgctttaaaaattatctttgaatgacttgttaaatggttattgatcgaatctgttattgattgtttatttattatctcttactgattatttattaaactttagagagaggggataaccctaaataggcaataccttgctttttaaggcatagcagaaaaaggcgaatgatattttcgcaaaggggtttaaaaggggaaatttgggtatgacgagaagttaaaaaatttttaaaatttattttgcaaggtttataaaaaggcgttagcctaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctcatattgttttcgtctatcaaatggttaagtaataaatttgggcgattttatcccaaatttattagtaagggaatgatttcgtgtattttatttgtattttacacttgttgttgattgtttacgatttgcaaccatgatttccacaacaaccgtgatgttcatggtgttcatgatgatgtccgccacatccacaatgatgaccctcttcatcattatcatgtgtacaacaaccgccctctgtatgaatatgaccatgtgccatttcttccagtgttgcttcacgcgttgcaatgacctctacggaaaaatgcaattcttgaccggcaagcatatggttaccatcaactaccacctcattttcatttacttcagtgataacaacaggtaatggcccaagatccgtatctgcgataaaacgcataccgactaccagctcatcaacgcccacaaaaatatctttgggtacacgttgcaccatgttttcattatattctccgtacccttcttccggttttacacgcacttcaaatttatcaccgacagatttaccttccagtgcattctccagtccgatcacgaggttctgatgtccatgtaaatattctaaaggttgatttgccggtgcttcatcaaccaatacgccgtcttcagtgcgtacttggtaagcgatacttaccacaacatttttttctactttcatttttattcctttatgctgtaaaagtgcggtcattttagccaaaatattggctattgtcattcatcttcatttggatattcgtcaaaaaattctccgtcattaccatattcatcttctgttgcattcggatcttcgaagtaagtaccccatccgtcataaatgccaccgaattttgtgattaatggcaataagtctttttgttgtgcatcaatgatttctgcttttaaattaacttcactaatgatgtcaaagcagaaaatagatttaccttgttcatcttcaaattcttccgcttcagaaacttcatagcctgctttgaaagcatcaacggcgattttttctaacttatcaaaatcgtcatgtgcgatatgatgttcaataatatataaagcatcaggatcactaccgtcattgagtaaatcagtaataatttttctagtttcttcttggagatctacaagtgcagtcatattttttcctttatgtttatttagggagtggggataaattcattgcgttgatataatttaattgtcgccatgcttcatagacggtaaccgcaacagcattggataaattcatgctacggctattttctatcattggaatacgaattttttgtgttgtcggtaagttatctaaaattgacattgggatacctctagtttccggaccgaacataagataatcgcccaactcaaaatttacttggctatgtgcaggtgtaccttttgttgtgagtgcaaaaagacggttaggttgttctgtgtttagaaattcattaaaagttttatgctttttgatttgtgcaaattcatgataatccaaacctgaacggcgtaattttttatcgtcccaagtaaatcctaagggttcgattaaatgtaaacgaaaacccgtattggcacataggcgaataatatttcccgtattttggggaatttccggttcatacagtacgatgtctaacataacaaaatcctcgtttatgcaacatggggaattttactcttttatcaactaatcacaaaattattcctaccgtttccttcaaaaaatacttctaagcaaacagaaagtgcggtctaaatgtgcataaaaaaggcggagaactctccgcctttcatgatggaaaatatattattaagctttaggaccagctgcgatgagtgcttttccttcttcatttgtagcatatttttcaaagtttttcacgaaacgacttgcaaggtcttccgcttttgcttgccattgtgctttatccgcataagtatcacgaggatctaagattgcaggatctacacccggcaatgcttttggaatagctaaatcgaagattggtaatgaacccatttccgcactttcaattgagccgtctaagatagcgtcgataataccacgagtatctttaattgagatgcgtttacctgtaccgttccaacctgtattgactaagtacgcttcagcaccagaatctttcatacgttttaccaacacttctgcgtattgggttgggtgcaaacttaagaatgctgcaccgaaacaggcggagaatgttggcgtcggctcagtaatgccacgctctgtaccagctaattttgcagtgaaaccggataagaagtagtatttagtttgttcaggtgtgagttttgaaaccggaggtaagacaccgaacgcatctgccgttaagaagataacttttgttgcatgtcctgcttttgataccggtttaacaatattgtcaatgtggtaaattggataagatacacgagtattctccgtttttgaaccgtcatcaaagtcaacggaaccatcctcacaaacgacaacattttctaacaacgcatcacgtctgattgcacgataaatatcaggctcgctttctgcggaaagtttgattgtttttgcataacaaccaccttcatagttgaagacaccgtcatcatcccagccatgttcatcatcaccgattaattgacgtttcggatcggttgaaagcgttgttttacctgtaccggataggccgaagaaaatcgccacatcgccatctttgcccacgtttgcagaacagtgcattgaggcgataccttttaatggtaagaagtagttcatcattgagaacatcccttttttcatttcaccgccgtaccaagttccgccgattaattgaatgccctcagtaatgttaaatgccacaaagttctctgaatttaatccttgctctttccaattcgggttagttactttagaaccgttcataaccgtaaagtccggtttgaaattttgcaattcttcatcagacggacgaataaacatattttttacaaaatgtgcctgccatgcaacttcagtaacaatacgcactgctaaacgtgtatcagggtttgctccgcaaaaagcgtcgataacaaacaaacgcttgccggaaagctgtttagtgaccaaccctttcaaactttgccaagtttcttggttcatcggcttattgtcgtttttcgccgcatcgctcgtccaccataccgtattttttgttttttcatctaaaacaatgtacttatcttttggcgaacgaccggtaaaaattcccgtatctaccgcaaccgcacctgaagtggtaacaacacctttctcgaagcccgctaaacccggtttagtttcttcttcaaaaagttgttcataactcggattatggacaatctcttttacatcatagatgcctaattcacctaattcatttattactttgtttaagtcagtcataaaacacctcatagttaaaagttaattttaaaagttaatcatttagtggtagacattatagtgaaaataagaaataaaaaatgttatcttgatctcaaaattgaaaaataaatgaaatgaatgttgagaattataaaaagcgatggttgaaccatcgctttgaattaagattaatatgattatggataaacaggaagacgtttgcaaattgctaacactttttctttagtattagcaatgacttgttcatggttatttttattcatactgtccaaaatatcgcacatccaaccggcaagttccgccacatcttcttcgttgaagcctcgacgagttacagcaggcgttcccacacgaatacctgaagtaacgaacggtttttgcggatcattaggaaccgcatttttattaacagtaatattggcacgacttaacgccgcatcagccgctttaccggttaagccatgattgactaaatcaactaagaataaatggttttctgtaccgttagagacaacgttgtaaccacgttgtttaaaaacttctaccatagcttttgcattttttactacttgtgcttgataagttttgaactcaggttccaaagcttctttaaaacaaacggctttcgctgcaataacatgaactaacggtccgccttgtcctgccggaaataccgcactatttaattttttgtaaagttcttcattgccgttggcaagaattaaccctccacgaggtcccgctaaggttttgtgtgttgtggtggtaactacatgagcatgtggcattgggcttggatatacaccggcggcaataagccctgcaacatgtgccatatcaacaaataaatatgcacctacttcatcggcaatttcacgcatttttgcccagtcaacgatttgagaataggcagaaaatccgccgacgatcattttcggtttcacttcatgagcctgtttacgcaacgcatcatagtcaatcagtccttcggatgtaataccgtattgctccgctttataaattttaccggagaaactgaccgaggcaccgtgagttaaatgtcccccatgagcaaggctcattcctaaaatggtgtcccccggatttaataatgccatataaaccgccgcatttgcttgtgagccggagtgcggttgaacgttagcataatctgcaccaaacaacgcttttgcccgatcaatcgctaattgttcaacaatatctgcatattcacaaccgccataataacgtttacccggatagccttctgcatatttattggtgaattgacaaccttgtgcttccattactcgtgggctggcatagttttctgaggcaattagctcaatatgctcttcttgacgaagattttcatcttgaatggcttgccataaaaccggatcgtaatcggcaatattcatacttctttttaacattatgttttcctctttgctcacttatgaaatggtaacagtttacctgttttaacttaaaaatttaattaaaaattaattcctatttttcatcggtgtaatgaaaaaatttcattcataaataccgataagattgaccgcacttttattgattttctcttgctacggcacgataaccaatatcttgccgataaaaacgtccgctccattggatttgtttcgccaattttaatgcttgctgttgtgcggcaaagacattttcacccatcgctgttacacaaagcacacgccctccattcgtcaataatcgctctcctttttgctcaactccagctaaaaaaactttttgattttcacccgcacttattggcaagccttgaatttcatcgcctttgcgatagctattcggatagccttctgcggctaaaacaataccaagtgccgcttgttcagaccattcagatttcacttgatccaatttaccctcgcaggcatttaaacaaagctcaaccaaatcagaccgcatacgcatcataatcggttgggtttcagggtcgccaaaacgacagttaaattcaattactttaggctgtccgtgtttatcaatcattaaaccggcatataagaaacctgtataaatattgccttctttcgccatgccattcacggtaggataaatgatctgttgcataattcgcgtatgaatttccggtgtcactacaggtgccggagaatacgcccccattcccccggtattcgggcccgtatcattttcaccaacacgtttatgatcttgtgaagtcgccatcggctctacatttttaccgtctaccataacaataaaactggcttcttcaccctctaaaaattcctcaatcactactttgctaccagctttgccaaaagcattaccggaaagcatatcttgaatagctttttccgcctcagccaacgtcattgcaacaatcacacctttgcctgtagccaaaccgtctgctttaacaacaatcggtgcatctttttcacgcacataagcaatcgctttttctgcatcagtaaaactgcggtattcagcagtaggaatatgatggcgagcaagaaaatctttcgtaaatgcctttgagccttctaattgagccgccgcttgagttggaccaaagatttttaaccctgatgctcgaaaagcatcgaccacaccaagcactaaaggtgcttcaggtcccacgatagtcaagccaatttgattttcttgtgcaaagttgaccagtgcatcaatatcagtagcggaaatagctacattttccaccgcacattttccgtctgtttccatagctgtccccgcattgccgggtgcaacaaatattttgcttgctaaaggtgattgtgcgactttccacaccaaagcatgttcacgtccaccatttccgataattaaaatattcattgtttttccttccttaactgttttttaggaataaagaaagcgggaggcgtattttccttaatatttaaataccctgaatctcccgttagaattgaatgattaattgtaccatccctacaatcagatatatccatatcataactcatgatgttaattaaaaatgtagccagttgctgatgaaacatttttttacaagatgaaaaatggttatgaaaaatatcttgtaaaaacttattttcagaataaataaaaataggcactaaataattagcttcatttaatgttccttgattatatacttcattagaaacaaactgtccgtgatcggaagtataaattaaaacccaatcttcaggttttaaagatgttttaagataattaaacactttttcaattaatttatccgtattatatatagtactatcatatttatctaaaggggtgttctctttgaaaactttttcttgctcagataaataataagcatagggtgtatgagatcctctttggtgtaaaacaacgaaatgcttcttacccccccccacctcacttaaatctatattttccagtaatggaaataagttatgatcatgcattccttcagaagatttatacccaaggctattaggaaaacgcaaatcatcgacccacgttttacccataagactcataatcatcatttgattttcaggttgtgaagaatagaaatatgtttcatatccctgctctttagctaagcggaataagttagttcttccgctaacaatttgttctaacccatttggttttggaatggcattaaacaatgatgggagagaaatagcagtccttgagcctgctgaatatgcaggttttaataatgtttcagtaggaaaattttttgataaagatgttaagaatggggtggtttctctctcataccccaatgcacttacattatttgcacttacactttctcccataatccaaataatattaggtatttggaatgagaatttaggtttcggcttcggcttatctttgtaataaaccgatacgttgctcaaattaaataaatcatagggtaaagttctacctataaaatatccaaaagaaaaataatttgctttaattcttgagtagcccggattggaagtaattcccagttcttgatcagaataaaaactacgaataaaaatataagccatacttaataggaataaaatatctgcaattaaatatgttttttttctaaatcttgaaatagaagaaaaaataagaatatcaaaaacaccccaaattatccctccggatattttatccaacatatgaataccggcatttgtaacttcccaatattctttaaacattaataaataatttgtaccattaatccagctttgatagacctcataatgaacattattaactaacgtactacaagaaaaaaataacaaaataataaaacgagttatcttatattttgagaaataaaataatgaaattaaaataaatattattagaaaactctcactaattttgtataaactatttattccaaaaaaatagcgataaagtatttcactaattaataaaacagcagaataactcaacaaaacaatgatatttttcatgaaaatccttatttattaatgtctaaaatgacgcattttagtgagtaccattaccatattatgctcattggcggcatcgataacttcttgatcacgcattgaaccgcccggatggattacgcattcaataccaacttttgcggctgcatcaatgccatcacggaacggaaagaaagcatccgatgccattacacagccttttacttccaaaccttcatcttttgctttgatccctgcaattttcgctgaataaacacggctcatttgtccggcaccaatccctacagtttgattatttttagcgtatacaatagcgttggatttcacaaattttgccactttccaacagaataaaagatcttccaactcttgtttggtcggttgacgtttactgactacttcaagatctgctaaatccaccatagataaatcagcctcttgtaccaacaaaccgccattgacacgtttaaaatccaagcgttgtattgcactttcccaattgccacacatcaataagcgaacatttttcttacttttcacaatttcttgggcggcggaactgacggtcggtgcaatgatcacttcaacgaattgccgctcaataatggcttttgccgtgtcttcatctaactcacgattaaatgcaataattccaccgaaagctgaggttggatccgtttggtaagctcgattataggcttcgagaatatccttgcccagtgctacaccgcaagggttagcatgcttaacaataacacaagccggctcggaaaaagattttacgcattcaagtgcggcatcggtatcggcaatattattataagaaagtgatttaccttgtaattgtttggcggttgagacacttgcttcttttacatcttgttctacatagaatgctgctttttgatgaccgttttcaccataacgcatagattgtttacgtataaaattaagatttaaagttcgtggaaattgaccgcacttcgcttcagcttcttcttcagctctgaaataaggttttaccatttgtccgaaataattggcgatcatgctgtcatattgtgcggtatgttcaaacgctttaatggctaaatcaaatcttgtctctaatgttaaactatttcgattttgatccatttcagcaagaattgcattaaaatcgccattattgactacaatagccacatgttgatgattttttgcggcagaacgtaccattgtcggaccgccaatatcaatgttttctactgcatcttcaagtgtgcaatcaggttttgctacagttgccgcaaaaggatataagttcactacaaccatatcaatagcatcaatttgatgttgcatcataacttcatcatctataccacggcgacctaaaatgcccccatgaattttaggatgcaaggtttttacacgtccctccatcatttcaggaaaacctgtataatcagatacttccgtaacaggaaccccgttttcagcgagtaattttgccgtcccccctgttgataatagttttacacctcgtttaactaaaccttgtgcaaattcaacaattcctgatttatctgaaacgctgagtaatgcttgacgaataggatgatttaattgcattgaatatttcctttattttaaccgacaaaaaacgcaggcattataacgcaaacgtttgctcttgtgtaaataaaaaagcctataattaagtacagaatgaatacatgtagcggtaaaattatttttccactgctttatatacgcactaaaataccctgacattttttgcaaaaatataccgcacttttttgttgaatgttgtgatgacgacgtgcggacaattgatgggtttgacattgacattgataagtaaacgttttgcctcttacattcgttacatcaaactgatgacacgtatccgccggaagctgaaaaatcttgttcatcacatgttgccattctgagccgtgaggttttacacgcccgaattgttgatacacaattaaatgtgccaactcatgaggaactacttgctgaataaattgttgcggattttccagcaataaagtgcggtttaattttatgctgttttgttgtaaataggcgacccctgctttcattcctcgcacatcataactgactgtcggcatcgcaaaattacattgaaaatattgttcagccagtattaagcaatctcttaaacgtctttggatttgcatttttatatgacgaaactcagctaaattttgttcagttttaggcataaagtgcggtcaattttgggtaagatttataaacaaaaggcgaactgttgagttcgcctcatatgagaaattaatcgttattttaaacttgcggcagcacgtaattcttctgcacgatccactttttcccaagggaattgttctcgtccaaaatgtccataagcggcggtttgacgataaataggttggattaaatccagcattttaattaagccataaggacgtaaatcaaaaaattcacgaatcagagcaaccagtaattcattggcaacttttcctgtaccaaaagtttccaccataatcgacgttggttccgctacaccgatagcataagaaagttgaatttcacaccgatcagccagccccgcagcaacaatatttttggcaacataacgagcggcataagctgccgaacgatccacttttgacggatctttacctgaaaatgcaccaccgccgtgtcttgccgctccaccgtaagtatctacaataattttacgtccagttaaaccgcaatctcccattggaccgccaataacaaaacgaccggttgggttgataaaatatttcgtctcttttgataaccattctgccggtaaaatcggtttaataatttcttccattaccccttcgtgaacagttttttgatcaacattatcagaatgctgagtggaaaggacaactgcgtcaattccgacgattctattatcttcgtatttcaacgtaacctgacttttggcatcgggacgcaaccaatctaatataccttttttacgcacttgtgcttgacgttccattaagcggtgagcataagtaatagcggcaggcattaaaacgtcggtttcattcgttgcatagccaaacataatcccttgatcaccggcaccttgatctaatggactttcacgatccactccctgattaatatcagaagattgtttaccaatggcatttaataccgcacatgaatgcccgtcaaagcctatgtccgaatgtttatagccaatatcgcaaattacttgacgtgttaagttctcaatatccacccaagcagaagttgtaatttcaccgccgactagagccatacctgtttttacataggtttcacaagctactcgagcttttggatcttgtctcaaaatctcatcaagtactgcatcggaaatttgatcggcaattttgtccggatgtccttccgatacagattcggaggtaaataaataagatgacatagattttccttaatggtagaaatttttattaatattttttttagatgttttaacgtctagacggctatattacgcttttttaattaaaaggcaagtcttaatttaggttgtataaagggacagattgtgaaacaatctgcaaattattcggcattgtgcggacaacaatattttcatttcaataatttaacaattctcaaaaaagaaaatatattggttagcacctacttcatgtcaaggttattaaaaattaacaattaattaaggtgaaggagagtgatcgatttcgatggatatcgccctaatgtaggtatcgtgatctgcaatgcagaaaggcaggtgctttgggcgaaaagatatggacaaaactcttggcagtttccacaaggtggcataaatgacaatgaaactgctgagcaggcgatgtatcgtgaattatatgaagaagccggtttaacaccgaaagatgtcgagattttatatgtttcaaaacactggctacgctataaattaccaaaacgcttacttcgtcatgataaccgaccaatttgtatcggacaaaaacaacgttggtttttattgcaattggtttctgatgaaaaaagaatcaatatgcagcacacaaaatcaccggaatttgatggttggcgttgggtcagtttttggtatccggtgaggcaagttgtcacatttaaaaaagatgtttaccgtaaggtaatgaaagagtttgcattgtttttatttgatacaaatttaaaatctcgactatctgtaccggaagaaaaaaaaatgttttcatcggttaagaaaaaacttattcacaaaaaaaatcataaatattcttcaaatcagtgagggggataaaatgttaaccttttttctcatttgtctaggtgtaggaacctttgcagggtttcttgctggattattcggtattggcggaggactcattattgttcctacgcttgtgtatttacttccgatggttggtgtgccggatcatctgctcatgtcaaccgcacttggtacgtctttcgctacaattgtcatcaccagtttttcttcagcacagcgtcattacaaacttggtaatgtagtttgggatgcagttaaaattctcattccaactctgatgttatcaacgtttgtttttaccggtattgtcagtcaattagataagagtttatccagtaaactctttgcagttttagtcgcttatatggcaataagaatggttatttccactaaaattcaaatcaaaaatactaaaaaactcactcctttatcgtcagttattggcggcgttttaattggtattgtgtccagcattgcaggcattggcggtggcggatttatcgtaccgtttttaaattctcggggtgtagatataaagaaagctattggatcttccgcagtttgcggcatgctattagggctatcgggggcactcagttttatgcgtagtggttggggcgttactgaaatgccggaatattcgcttggttatgtctatttacctgctgttttaggcattaccatcacctcattttttacgtcaaaaataggtgcaactacgacatccaaactgcctgtacctacattaaaacgctatttcgcaataatgctttgtgtgattgcacttaatatgctttttaaataaggaaatttaatgaatacattttttcaaatgccctatattgatcctgtcatgtttagcttaggacccgtcagtttacattggtatggtgttatgtatttgctcggttttggttttgcttattggctcggaacggctcgggcgaaaaaatcaaatggagtatggacatcagaacaactggaacaattattatacaacggattttttggcgttattttaggtggaagaatcggtgatgtgttcttttacaacgttgataagttttttgctgatccactctatctatttcgtatttgggaaggtggaatgtctttccacggtggattaatcggcgtcattctcgcaatgatttggacatctcgtcgccaacgtcgctgtttttggcagactgcagattttgtcgctcctttaattcctttcggtttaggcatgggaagaattggtaactttattaacagcgaattatggggaagagtaacagatgtaccttgggcaatcattccttacgcttcaaccacacctcgacatccctctcaactctatgaagcctttttagaaggtttcattttattaatcatcttaaatctctatattcgcaaaccacgcccaaccggttccgtagcaggattgtttctaatcggctatggtatcttccgtttcctagtggaatatgtacgagaaattgatcacaacgtaaataccattgatgaccttctcactcgagggcaattactctgtttaccaatgatattcggcggacttgccgtgatgatttggtcttattctcgttcaaaggcaaataaaagtgcggttaaaaaagggtaaatttttatgcgtcaatatttaaatttatgtcaacgtattattgatcaaggtcattgggtcgaaaacgaacgcacggaaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatgggaagagtatatggcgtacaaggtcgtcgttggcggaaaccgaacggagaaactgtcgatcagctacgtaaaatcgtcaataacctgagcaaagggattgatgatcgaggagagattttaacctttttcaatcccggtgaaattgatctgggttgcttacgcccctgcatgcatactcacacattttctttactgggcgatacactttatttaaccagttatcaacgttcatgtgatgttccgctgggactcaatttcaatcaaattcaagtattcacattcttagcattaatggcacaaattaccggcaaaaaagcgggacaagcctatcataaaattatcaatgcacatatttacgaagatcagtttgaattaatgcgtgatgtacagcttaaaagagagccgtttccgcttcctcgattagaaattaatcctgatattaaaaccttggaagatttagaaacttgggtaacaatggacgacttcaaagtgattggctatcaatgccatgaggcgattaaataccccttctcagtttaaaaaataggaaaaacctcaacagtgcggtctgattttgatgaaaaaatgatgcgttatgccttatctctagcggataaggcggaggcattgggagaaattcctgtcggggcggttttagtggataaacaaggcgatattcttgcagaaggatggaacctatccattattcacaacgatcctaccgcacatgcagagattattgcattacgccaagccggacaaaaattacaaaattatcgtttacttgacacaaccctctatgtcacgctggagccttgtacgatgtgtgccggtgccattttacacagccgaatcgggcgtttagtattcggtgcttatgactacaaaacaggtgcggtcggctcacgctttcatttttttaatgattacaaaatgaaccatatgctggaaattacagggggtgtgttgcaagaagaatgtagccaaaaaattagtacattttttcaaaaacgtagaaaacaaaaaaagcatttaaagcccaactttaaacctttcctttaattcttgtaactgatctctaattgcagccgctttttcaaattctaaatcttgggcaaatttatacatctgttgttcaagttttttcacttgttgttgatagtccttaggcgaatttatcttttgataaagtgcggatgattccgccacagttttagcacgagcctttgttttacttttcgttatagcaccttgcccaatatccagtaattcgcccacttttttatttaaagcctgtggcacaacgcctttttccgcattgtatttcatttgtttttctcgccgacgatgagtttcatcaatcgctttttgcatagatttcgttatgctgtctgcgtataaaatcgcttttccgtttaaatttcgtgccgcacgaccgatagtctgaataagagaacgttcagaacgaagaaacccctctttatcggcatctaaaatcgcaactaaggaaacttccggaatatccaaaccctctcgcagtaagttaatcccaactaatacatcaaattcacctaaacgcaaatcacgaatgatttcaacacgttcaacggtatcaatatctgaatgtaaatagcgaacccgaataccatgttcttccaaataatccgtgagatcttccgccatacgtttggttaacgtggtgaccaaaactcgctcattttgctccgctcttttccttgcttccgataacaaatcatcaacttgaatcgctacaggacgtatctccacttccggatcgagtaaaccggtaggtctcacaacctgatcaataatttcatcgcccgatttttccaattcataaggccccggtgttgccgaaacgtagatagtctgcggtgctaaacgctcaaattcttcaaaacgtaatgggcgattatccaacgccgaaggcaaacgaaaaccgtattccacaagcgtttctttgcgtgaacggtcgccacgatacataccgcctatttgcggaacagtgacatggctttcatcaataattaacaaaccgtcacttggaatataatcaaataacgttggtggcggctccccctcatctcgccctgataaataacgtgagtaattttcaatccccgaacaatatcccaactcattcatcatctcaatatcaaattgagttcgctgagttaatcgttgttcctctacaaggcgattatttgccaacaaatattcacgacgtgcctgaagttccaacttaattttttcaatcgcctctaaaatacgttctcgaggtgtaacataatgcgttttaggataaatagtatagcgaggtatcgcaccaaaattcgctccggtcagtggatcaaataaactcaaacgctcaatttcatcatcaaataactcaatacgtactgcccgatcatcagattcagccggaaaaatatcaataatttctccccgcactctaaatgtccctcgttgaaaaacctgatcattgcgggtgtattgtaattctgccaatttcgccaaaatttggcgttgatcaacaatcgcaccatgttgcaaatgcaacatcattttcaaatagctatccggatcgcctaaaccgtaaatcgcagaaacagaagcgactacaatcgtatctcgtcgctcaagaaaagatttagtcgcagacaaacgcatttgctcaatttgatcattaatcgaagcatctttttcaataaacgtatcactactcggcacataagcttccggctgataataatcataataagacacaaaatattccaccgcattttccggaaaaaaagccttcatttccgcataaagttgagcagccaaagttttattaggagccaacaccatagcaggacgattcaatttcgcaatgacattggcaatcgtaaaggttttacctgatccggtaacgccaagcaatgtttgatgtgctaacccatcattcagattctccgctaattttgcaatagcttgtggctgatcaccggcgggttgaaagtcggaatgtaaaataaaaggcttactgttaattttgctcatagcaacaaaaatactaaaaaagggcggtgcattctagcataaaaaaacgtttctttactgacaaaaataggataagataacccgaatttttacttgacaaataaaatagaacagaaaaaatgacagtctacagtctacagtctacagtctacagtctacagtctacagtctacartctacagtctacagtctagtatgttgcctaaaatcaacctttcaagttaaatttgagaggttggacatgttcaaacaatatcttaaaaatcacctatttcaacctcaacctttcggcgaagataccattcgcctttttttgttgtgtcttaaaaagcaaggcatttcctgtttaggtttataaccaactcctaaaaagtttactaaacaatcaatcaaaatcaacgcaagaaataattaatttaaaaaatccatttttaaagagaatagagatatgaacaaaatattcaaaaccaaatacgatattaccacaggtcaatgtaaagccgtttctgagttagccagcaatcgccaaatagcgagcagttcggagagtaagccgaagtgcggtgggttttggggtaattttttaagagcgtttaaggtccttccgttggcgttgttgcttgcgggatttttctctaattttgcttatgctgctgatgtttggttagaaaataaaaaagacttatcacaaaatggacagttaaatgaggggactggtgtttggtttgacggttcaaatatggaaaacccgatcaaaactgagtcaaccatcttatcgagtggagaaaattcaacaggagaatttgctcaaaaagctggttttaaaaataaaagttttaataggacagtcgtaataggctcacgtgccgttggaggcggagatgctactacggtaataggttatagagcaattgcaggagcaaatttatctgaaagacataaattatcttcgcaaggtacatcgataggttacagaacatttgctagaggggaaggggctactgcaatgggaaatgattccactgcatggggagataacgctattgccattggttctgataatgcgaaagcaacaagcacttcacaaatagacagcagagcagaacgtcctttaagtagagatgtttggaatcttgtacacagcaaaagaagtgattttctttatacagatgaatacgcaacaacatatcaaaagttggatacttatgacaagtatttaggagtaaaagatgattctgaagcatataagctaaaaagatcccacacatgggcaaggggacataactctatcgccattggggcaagaagtatagcctacggcgataacagtacggctatggggacgttagcgacagccatcggtaactactcgacctcgttgggggcattttctatggcgtttggagatcgttcgattgccatagggaatgaaagctatgtgtatgccggcggaagtgtcggggttggtaatgaggtgcaggcaatcagtgatggtgcgatggtttatggcttggaatcttatgcgggcggtgatggttccattgccatagggaaacgtgctttagcaaacgtagaaatgggggatatgtttaagaatgctgttgaaaatggcaagaatttatacgaagcagagagtactttttcaaagttaggcgaattagataatagcgttcaagattactttaaaccaagcactgagtatcagcagggttccggggaacacaaagccaaacgaaataaaaactcaggcaagcaagatgctacaggcggtttagccattggttactatgtatccgcactaggggaaaattcattggcgttaggtcgtcaagcctatgcgaaaggcgatcgctccatggctatcggtccttatgcctatggtgctgaggaaaaaactgctgcactgggttatrgatccaaggckataggaraacaatcaatggcgttaggatcgctatctcgtgcagaggggaaaaacagtatcgctattggggtcaatagtgcggtgaaaaatgaatctagtagtaataaaagaaacggtgwaaacacgatagccatcggtaacgaaaccgaagcgacgatggataactcmgtygccttgggttataaatcmacsacraaatatttttataataagagtgataacagtamcgccacgttanacggarnngaagccatyastttrccatcytatgcaccggaagggacaagytataagttacaaaccgataatgcrgcsggtatcgtgtccgtsggytggaaaaaaagcgawagtgarctkggyytaagaagaattgtcggggtcgcygcaggagcwttrgactccgacgtsgcaaccgtgggwcagttaaaagccttgtattaygtsaaaaaagaaggkgtrgtmacttactataccaaagaasctgacggsaaaatcacyaaactcaccaaagacrgcagtaagttttataragtcaacaccaaagacggcacgccttataaagagttrsaggaarttkmygcarawrawgttttcgtcggtccaaaaggggcgaatgaagnaacaagagaagaaatgaaagacggcaaaaaatattcccttggtaatatgggtaatctaattaaatttgccaatattttagatggagagatttctgcgacttccgatcaggcggtaacgggtggtcagcttaacgatcttaacggcaaattaggattgacactaaatagcaaaaaaacaggctttgagaaagtccaatttgatgcagtagatgtagctgatgaaaacgttaaaaaaggaaaaatagaaaatttcaaagaagccttgactgactctatcgctgcaattaatagaggttataaatttattgatgacaactctcaaaattcagacaaagatacacctttctatctcggatcaacaataaaaattgtggcaggaaatatttctgcacaaccgaatagcaaacctcaagaaacatatttaggtaaaaacctcaaaacaaaatttgaaaaagagccaagcaacaattcaatcgctaaatttacgattggcttaaaagacgatccgacatttacaaaggtatccttagaggcagaacaaacatataattctgacccatcaaaaaatacagtcaaagatacaaaagaacttatcactaaaggttacttggacggtgcattaaaaaatgtcgcctcaagtttcacggttaagggagatgatacaagtaaatcattgagcattgataaaaatcatacgactttaactattaaaggcggaaacaatattaccacagcagttgatactaaccaaaaagccttaaccatatcgttgaatgagagtttaacaggtattacctcaattagcggtaaaaatggtagcggaagtaacagaagtgcggtagcaaaaattgagtttgatagcactgcaagcggtagcaacgcttcaaccccgaatgtcaaaatcaccacaggtggtggcacatttatctttagtgaaaacggcttaaatttgggtagcaaaaaaatcactggtttagcagagggttcagacgacaccgatgccgttacctttaaacaactaaaagattcaaaattgcactttttatcggttaaagccccgacaagcccagagtcaaaaagcaattacaataatgacggtgcaaaagctgaaggggcgattgctatcggtgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagacgtgaaagcccaaagtgcggtagcgattggnnnnnnnnnnnnnnnngaagccaaagccgcaggtgcggtagcgattggcgaaagtgcgactgtatccactaacgcaggkgattctattgcgttggggaaaaattctaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagtgaacgtattatcaccaacgttgcagcaggtaaaattgatacagattctactgatgcgattaatggctcgcaattagatagcgttatccgtgtatttggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattcagtggcgtgtctgaaattagcagtaaagacagtaaatctaaattaacacttggtgctgataacgcaactgtagaattagaacatggcaaatcaaaacttgaactaaaagatactgaagcaacaatcacagcaggaactgatgctggaagtattaaaattannnnnnnnnnnnnnnnnaaaatcgagttaagccctgaaagkggttctacagtkaccttrgyaaaagatggtamrratggcgtaaaagccacgggyttrtctasggttgggttagatgryrryaaygctttagtgtttaaaaatggtacgagtgacactaacacggcrgagttaaaagtsggyggtgcagctttaacattcacctctactggaaatggaactggcggaactgctcaaaccgtgaaaatctctaatgtggcggttggtaatatagcgactgattcaaaagatgccatcacgggcggacaacttcatgatttagcaagtaaattgggggttgctgttgatagtggaaaaactacgtttacagcaccatcatttgaagttatcaaaggcggtactaaagacgcaacgagcggtacaaatcctccaacaacctttaaaggrgcgattgascagttaatcacsgcrgtkaatggtggcttgamwtttaaaggcaatgataacagttcgactaaattacaattaggcggnnnnnnnnnnnnnnnnnnnnnnnnnnnnnnnnntggtagtgaaaaagacattacagcaaaactggaaccgtctaatggtagtgatcctaaagataacggtaaattaacgctgacgttaaataaagctacttctgtagataaaaatgacgaaaaagtcattacctcaaaagccgtagcaactgagctggaaaaatatacgaaaactgctgatttaggtaatacgtatttgaaaatagacgggtcgaatattggtggtgcttcnnnnnnaaaaacattcggtggtaatgtcggtattgctgaaatcaagttagatagtgaaaaaagcagcactgaattagtacaggcggatgcggttattaagtatctaaaaggtacaggaacagattctgtaaaaatatcagactcaacaaagacaatggctaaaggaaattactcaataagtataggacatgaagccgtatcagaaaatgnnnnnnnnnnnnnnnnnnnnnnnnnnnnnnnnnnnnnnnnnnnnnnnnnnnnnnnnntaggtaatgaaagtgaggtattgggcgagaaatctattgcaataggttcagaaaataaagtagatggtgagggtaaatactcagcagtattaggaatagagaataaagtatcaggtaaatttagttattcagtaggataccacaatgatattaaaggagataatacctttgtattaggatctaatatattaacagacaattctattaaaaatgcagtaatacttggagatagatcaaaagctgaagcaaatgcagtatctgtgggtagtgctggcgatggtgaacaaagaagaattgtttatgttgctgatccaacgagtaaatacgatgcggtgaataaamamtatgtygatgcacttggattaaaattcaaaggtaatgatgataaaaatatacacagaaaattatcagaaacattagaaatagttggtaagggattaaataaaaaccaaactactaaatttaatggcacaaatggaaatattgctgtaaaagaaaataaagggaaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaataaacaaattacagggttaagaagtggactattagaaaaacataatggacaagatggagaaagaaaagatttagactatttaataggaaaagactttgataaatcatcgattaaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcgactggacaaccagcagtaactgttggcacaggaacaacttctcaaacatcagctgttaagtacacaggagataatttaacaactcgatatacctatgacagtagcaatggcaacgccaaratcgaaatmgggtttaaagacgcaccgacatttagcaaagtgactttatcasaagctcaaacgtatggtaatagtagcaatgttggcgacaaggacctgattagcaaatcctaccttgatgccgcattaaaagactttaagtttaatgtggaatatggtggtcagaaagtccaaatcggtcgtggcgatacgttgaagtttaatgctgggctgaatattaaagtagagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcagagataaccattgcaacgactgatgaattgaaaaacatcacttcgatttcctctaaaggaagtgcgggtttaaatgcgggtgactcaactgatgaagtcactaaacttactttagatccaaatagtggtgcaactttccaagttggyaamacaggttctaaagtgaatgtcaatagcgatggtatttccctcacgccacaaggggcgaatggtacgagtccatctgacgatgtagcatcaatcgttattaaagcaggcgcaaaatcagtggatccaagcaatttagattcacttgatcctaataayggaccttcaatagcgtttgcarccaaaggcggtagtaatggttcaaaagagggaacgggtacaattaaataccttaaagacagaactgttagcaaaaacaatggcaacggcgataaatacggtacaggcgataacaaaggcaacgctgccacagaaggggcggtgaaagagctttatgactccggcttgaaatttgccggcaatgaaggtgagcctgttcacaaaaaactcggtgaaaccttgtctattaaaggcgaaggtgcggttggtgaaacggcgacggataacattgtggtaagagccaaagagggtgaactgcaaatcggtctgactaaaaatattagaaatattgacaccatttctatcgctggcacaggggacaatagcggtaaagatgtctttatagatgctgagggtatgaccactactgctcaacttgaagatggcacggtgttggtgaataaccaaacggctgaaggtgtcagtacaatagctaaaaaagaggatggtagcattttggtgaataatcaaacagcagaagcgaatattttaagcaatggcaagcacacgacagaggtgaaagccggtgaggtcgctattaaagacaagagcggtcaagaaatcgtgagcttgaaagtggctgagggtgaaaacggtcaagatggcaagggagcgacgcttgcgtttgccaaagatggcgaaaacggtacaggcgtaatcatgggcttgaaagacctagatgccactgctgacggttcaagtgcagcgaataaaaactatgtggatgaaaaaatgtccgatttggacagcaatcgaccgtttgacttctatatccaagagggcaaagagtataccaaagtcgtcaaaggacgtgatggtaagttttatgatcctgagcttttacaaggggcaaagtatgatgtggacagcaagaaatacattgctcaagatggacaagaagttacaccggaatcggataaagtcattattcgtgctgaaccgactaccgcacctatcgggataaataatgtggcaagtggtttggggatttcggctatagaagaaagcgaaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccaatgcactttcgcaagttgccagcgaacgtcctgcgttgctaatgcaaaaagcggaaattgaacagcaacttaagggattgggtgcgagcgatccacgaagagcaaccgcacaagccgaacttgataaggtaaaagaggctcttacacaaaatgatcaaaaggtgactgaggcgacaaaaacagctaatgaggcttccgaagctctcaaacaagcgaaagtcgctttggcagacaacgtgttaaaagcctatgcagcacaacaagcattagctactgccgaggaaaccttgcgaaataaagaatttggcgtggataaggtgaaagacttactgtcaggcaattcaaatattgctgaggataatgtggctactattaaagatgtgaaagcacttgctaaagcaggattaagttttgagggcaatgatggtaaacgcttgcataaagatctatcagaaactttagcaatcaaaggtgaagaaaatgcaagtggtgataaatttaatagcgaccacaccgccgccggcaatatcaaagtggaaatggcacaagacggtaaaggcttagaagtcaaattgtctgaccagttgaagaacctcacatcggttgaaactaaaaaagacgaccaaggcagatcaacaacattgctgtcccgtggagtgatggttcaaaatgacaccacaaaagaacaagccctgttcagcgaaaaccgtttagcgttctttaaagatggagcgttaggattgaatttagacggtaagtctcgtgcattgaaagtcggtgaaaaagcgatcatcagtataaacgacaaaggtgaagcattggtttccgatctgaatgaatttagttcaggtatgacaattaccaataaaaactatgtggataccaaaaacaatgagttgcgtacgcaattgaataatactgaccgcactttacgagcaggtattgccggttcgaatgcggcggcagggttggcatcggtctctatgccgggtaaatctatgttagccatttctgcagcaggttatggcggggaaaacgcagtggcaattggctattctcgcatgagtgataatggtaagattatgctacaactgcaaggaaatcggaattctagaggcaaagcggcgggttctgtttctatagggtatcaatggtaaattgattcgattgtgccttatgtccacattttgttattgaggatataaggcataaaaagcgtgctctgttttaaaatcaacttggtaattgttgttcgatttattgacgagttattaagtttggtttctttttacatagacaaggtttaaaatggattagattctgttttaaaccttttttacaattaggcaaagcacttaatatcaagaataactgtctgtatctatttcaaatagctatattgctatctatgatgatggaatattgctcttgatgtttgtagcaaaaaattacatagactttaaacgaggagaagaaatatggaaaaattcgatgttgtgattattggtgcaggaccttccggttctgtttctgcatcattattgcataaacaaggcttaaaggtttgtgtattggaaaaacagtactttcctcgttttgtcattggtgaaagtttgttaccttattgtatggatattttgcaagaggcggacttggttgatgcggtacatgccgagaaaagttttcaatttaaaaatggggcggcatttacttggggaaatcgttacacctattttgattttacagataaatttaccgctggacctggcacaacctatcaagttcgccgaggcatttttgataaaattttaattgatgaaacggcaaaaaaaggtgtggaagttcgttttgggcacgaagtatcggcgtttgataaccaaggcgatcaggcagagcttgcggtaaaaacggagcaaggggaagaatatcggctgagtgcaggttttgtgttggatgccagcggttacggacgtgttttgccacgcttattatatttagaaacaccatcgcacttgccaatacgtattgcacattttacccatattgatgacaacattgatgatccgatctttgatcgtaataaaattctcattaccacacatcctgaacatcgtgatgtttggctttggttaattccctttgcggataaccgttgttcaatcggtgtagttgggttaccggaaatattggcgggtgagagcgaaactgtgttgaaaaaatttgctcttgaatgtccaatgctgagtaaaattcttgctaaggcaaattgggaaaatgaatttccgtatcgccatattcaaggttattccgctaatgtgaaaacgttgcatggcaaacattttgctttattgggtaatgctgcggaatttcttgatccggttttttcatctggcgtgactattgcgttacattccgctcgactggcaagtcgtcttattgctcgtgggcttcaaggacaagcggtggattggcaacgagaatttgccgatccgttaatggttggtgtgaatgcgttccgtacttatgtaaacggctggtatgatcgtagtttccaagatgtcatttatgcccgtaatccacaacctgaaattcgccaaatgctttcgtctattcttgccggttatgcgtgggatgagaaaaatccgtttgtggcgaaatcctcccctcgcttgaaagcacttgcggaattatgcggcgaggcaacacaagattaagataacaatatataagcattcaaaaattgctatttgcaaacgttgagtgcttttattttttcataaggaaacaccatgccatcgtttgaaaatctttcttttattaccgcacttttatttttttgtatttgtctcattttattttttatttttgtacgtaagcaaagagaggtggaggcgttacaacaagagttagataaaaatattaatatttttaatcaattgctgaataaatatgaacgtataaaagacgaaaaaactcagcttgggcaacaagttgtaaaggcacagacacttgtcgaaaccggtcaaattcgtttgtcggaacgtgatgaaaaaatcctttatttgcaaaaagaattagataaagaacaattacggtgtgagcaagtttctcagctggtaacaggattgaaagagcgtttgggggtagtaagtacacaggcggaaagttttcaacagcagttaaatcaaagtcgtgcagaaaaagaaaagagagattgtgcttgggctgatttaaatcagaaacataccgcacttcaacaagaactgacagaattaaaagtcacgttaagtgaaaaagaaaaaaattttgtcgagcaacaacaaaatttttctcaggctaaacaactgttaagtgttgagtttcaaaatcttgccaatcggatcttggaagaaaaaagtcaacgatttaatcaaactaaccaacaaactttagacagtttattgaaaccttttcgtgaacaaattgatggttttcaaaagcgggtgaacgaaattcattccgagtcattgaaaggcaatgccagccttgaaagtgagattaaaaaggtgttggatattgggttggcaatgtcgaaagaggcgaataacttaacttctgctttgaaaggcgaaaagaaaaccttggggaattggggagaagttcagttagagcgtacattgcaattagccggattgattgaaaatgagcattacagcagtcaagtacattttaaaaatgagcagggcaaacataattatcctgattttattttgcatttacccgataataagcatttgattattgacagtaaaatatctttggtagcttatgaaagtgcggttaattctgacgatgaaaatcaacgtaaacttggtttacaggaacatgttaaagccttgaaaaatcatattgacgatttatctcggaaagattatagcaatttgattggtatgcgtagtccaaattttgtattgatgtttgttgctgttgaagcagcttatattgaagcgatgaaacatgacagtaacttatttaattacggatatgaaaaaaatgtcattttagtttctcacacgacattaatgcctattttgcgaaccgtagcaaatttgtggcggattgagcgtggtaatcttgaagcaaaagaaattagtgcaaaagcaggtgaaatttataatcaaatttgcgtagtggcagagcgtttaaataaattaggtaacagtttatccggtgtaagtaatcattataataataccgttaccgcacttgtaggacagcaaggtttggtgggaaaagttgagcggtttaaggatttatctgcaaaagcgaacaagataatgccggagattgaattgttgcataatgatataaacgttgagaagttaattgccgttcaagctgaagtcgaagagaaataggatttttagctaaaaatcttttaaaataatgacaattttgacataagagggaatacattatgattattgttacaggtggagcaggattaattggaagtaatatcattgcggcattaaacgatatgggacgtcgagatattttggtagtggacaacctgactgatgggacaaaatttgtcaatttggtcgatttggatattgcggattattgtgataaagaagattttattgcctctatcattgctggtgatgattttggagatattgatgcaattttccatcaaggcgcttgttctgctacaacagaatggaacggtaaatatttaatgcaaaataattatgaatattcaaaagaactattgcattattgtctattgcgtgaaattcctttcttttatgcctcaagtgcggcgacttatggcgataaaacagactttattgaagaacgccaatttgaaggtccattaaatgtttatggttattcaaaatttttatttgatgaatatgtgcgtcaaattctgccacaggctaagtcgcctgtttgtgggttcaaatatttcaatgtatatggtcctcgtgaacaacataagggttcaatggcaagtgttgcattccatttaaataatcagatgttgaaaggagaaaatccaaaattatttgcaggatcagagcattttttgcgtgattttgtttatgtgggcgatgtggcaaaagtgaatttgtgggcatggcaacatggtatttcaggcatttataattgtggaacaggtagagcggaaagttttgaacaagtagcaagagcggtgttgaattatcatggcaaaggtgaaattgaaactattccgttccctgagcatttaaaatcacgttatcaagaatatacacaagctaatttaacaaaattacgtgccgctggttatcaagcagaatttaagtcggttgctgagggagtagcggaatatatgcaatggttaaatcgcaagtcttgatttagcgaggaaaatagtgttaaaagtgcggtttaattgggtgttcatttattcggtattccttttaaatctgcaactaaaaagactattttgctttataatatcggcaatcttcactgttattggtcaaaacctatgaaaattctcgtaattggaccttcttgggtgggtgatatgattatgtcccatagtctgtatcaaaccttaaaacaacaatatcccgattgcctgattgatgtattggcaccgaattggtgtaagcctttacttgcacgtatgcctgaggttcgcaatgcgattactatgcccattgggcatggttcctttgacttaaaaggtcggtatcgaattggtaaatctttgcgtaatcaatatgatatggcgattgtcttgccaaattccttgaaatcggcttttattcctgcctttgcgaaaattcctgtacgccgtggttggataggagaaagtcgttattttttgttaaatgattggcgtcgcaataaaaacgactatccgatgatggtacagcgttatgtggcattgggttatgataaaaccgtattgccgacagcaaaacatttagccattcctaagccttatttacaagttgatgctcaagcgttggaacaaactttagaaacttttgcaaaacaaaccgcactttgtacaaatcatccggtaattgggttttgtcctggtgcagaatttggtcctgcaaagcgttggccacattatcattacgccgatttagcccgacagttaattgaacagggctatgccgttcgtttattcggttcggtgaaagataaagaggtaggtgagcaaattagtcaagcgttgcctcaaaaattacaacattattgtgtaaatcttgctggtgaaacagacttaaatcaagctgttgatttgatttcagattgtgtagcggtggtaagtaatgatagcggtttaatgcatattgccgccgcacttaacaaacctttggttgctgtttatggaccaacaagtccggaatacacgccgccactttccgacaatgctgtgattattcgtctaattgagggaggcttgattaaagtgcgtaaaagtcaagatagctcggaaggttatcaccaaagtttaatcgacattacaccgcaaatggtcatcgaaaaattacaggattttttaaattaatatgaaagtttgtttgattaaaaccagctcaatgggcgatgtaattcatactttgccagccttgactgatgctcaaaatgctattgctgatctgcaagtggattgggtggtggaagaaaattttgcggaaattccccgttggcattcagccgttaatcatgttattcctctagcaatacgacgttggcgtaaacagcttttttccgctcaaacaagaaacgaatggaaaaattaccgcactttgttacaacaaaatcaatatgatgcggtaattgatgctcaagggttagtgaaaagtgcgttgtttggagcgagtttggcgaaaggggtaaaacatggttatgatcgtcattctattcgtgagcctttcgcctcatttttctatgacaaaaaatatactatttcttatcaacagcatgctgttgaacgtattcgtcaattatttgcccaaagtttaggttatgaattgcctcacgaaaaaggcgattatggtattgcgaagcattttgtgcattcgactgaaaatgcacaacattatgtcgtttttgtccatagcactacaagagcggataagcattggctcgatgcggaatggaaaaaattagcccaaaaattgaccgcactaggtttgcaaattcgcttaccttggggtaatgaaaaggaaaaagcacgtgccgattggattgcacaagatattcaaagtgcggtagttttaccgagattttctttgaccgagttggcacaacagattgcctatgcaaaagcggtagtttctgtggatactgggttagcacatttgaccgccgctttagatgttccgaatattactttatatggagcaacagatccgaagttgatcgggacgtatggtaaacatcaacattatattcagaaacagggtatggcgttgattagtgcggaagatgtgttgagtgaattacagtcaaaagaaatattgaaattttaaccatagaacatctgcactttgcatttacactaagtgcagatgagtttgattataaacggataacgccgtcataaatatgtgttgcctcgccggtcatataaagtgggtgtccttttccttgccattcaatcattaaccttcctcccggcaaatcgacttgtacgcaactacctaaaacgccctgcataatgccaacggcaactgctgcacacgcaccgctgccacaggcttgtgtttctcctgctcctctttcatacacacgcagtttaatatgattgcggttgataatttgcataaaaccggcatttacacgttcaggaaagcgttcatggctttctaagagcggtcctaatatttcgatgtttgcgtgttgaatatcttccacttgtgttacacaatgtggattgcccatagataccacaccacatagcaaggtttgtatgtctgtgcgaataatataatttttttcaaatttattggcgttaaaagggattttattcggttcccaaatcggttcacccatattgacacataccatgtcatcgtctttaacgcataacatcattttgccttttgcagtactcacggcaatttcttttttattggttaaacctttaagcacgacaaaacgagcaaagcatcttgcaccattgccacattgcgaaacttcactaccgtccgcattgaaaatacgatagtgaaaatccaaatccggatcataaggcggttcaacgactagcaattgatcaaaaccaatcccacgattgcgatctgccaatctttttatgacttcagtgggaaaataaacgttttgagtgacagcatctactacaacaaaatcatttcccagtccgtgcattttggaaaattgcatttcctcttccttaagcaaattaaaattggggctattataatcagcggataaagttgagtaaatgagagaaatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaattctaaaagcaatattctctccgcactttgaggcggggagaatgttaggttgttgttttgtaccattccaaaataaatgcggcaatttgcgtcgggttgttaatatccagtaaaggaacggaagtctgtacaggataatctgtcgctaacgctattacatattcatcacaaggcggacaaggttttgtcatattttgacgatgtaataaaattttggcgatggggtcttgtttaaacccttctactaaaattaaatctgtcaattggggtgaaaattgttgagcaagataatctaaagtgacaggttttggcgtttcggtcattaatgcccaacggttatcacatgccaacataacttgtgtcgcaccagcctctttcatacgccagctgtcctttccctctttgtcgatttgtgcgttatgatggctatgtttgattactgaaacccgcaaacctaaacggagcaattcaggcagtaatttttccaataatgtggtttttccactaccgctataaccggtgatacctagcatgggttgcatataaattcctcttttattgaataatgcgtaacagaatgggttgaaaggcctttttatgttgccattttttactgtatgaatggataagcacaaaagaaagtgcggtacaaaaaaggataaaaattgcaccccacaattcttggctaaaaatttggtttgcaatgagtgttgcactgagcaaggtcattaaaggaataatatacaataaaagtgcggtagaaatcagagaactttcttgtaaaccaagctcaacaatttgacctatttttaagggtatcaggctattaacgataaagatatgctccggacttttgccggttaattcagaaagtgcggaagttccgcaagaattttttgctgtacattggctacaagcatttttgctttgacatttcactgttgcttttccttgatgataggcaatgactatcgctctttctgttagcataaaaaacctatttaattcgaatatcttgaataatacgtttagcggaaaagagaggaagttgaccgacaaaggttaattctttgttacctagagtgttgctgtaaaaagtggtggagccttgcttccaaaatctttctccgtcattatcaacaatgctgttagacaaatagagtgcaaaagaaaatagtccgtcactataaaattggctctcaatagggtgtttattgtctttttctattgttatggattggctaattaacttaaacccttttgggagccactccggtttccaattttgttgctgagttttcggctcacttaataacggaggaaaaatgacattatctatatagctacctaattcgatcagttcatcaccaagatataaattaactactcggaactgctctaataaattgccttcacgatccaacatatcactgcgtagcaacaaatgattttgttcatcgataaagactaaatattgatagcgaaaatcgtctttaggcaaaatacgtaaagtttgtacaatgcgatccgccacacgattacgcccaatggttacgatatcgtaataatctgataattgcttaacatcactccacattacaacaggtaagttatccataatatgaccgctctttaaagagaatgcttggaaattaggtggaaaataactcactaaattttcatgttggataatttcttgttgaacaccatctaaggtaataagttgggcgtaacttttgccatcctgattaatatgacgataacgaagtgaatctatattggttggtgtggcttgtacaaaataaatttcataatttaatgtattttgtgctgcaatcattttttccaataattgctcaggttctatattttcttgagcgaaagttgaaactgaaaaagtaagaagtgcggtcaaaaaagagaaaatttttaacatagtattcttcctaagaaaaaaattcaccaccaaacggtggcgaatatcttaacatgaattgagctaatgttcattatttggcaatccgaaactgtcagtatgcagacgtcgttgtaattcatagttttgtaacattatgccaatacgtttgttccgttgttctacttgctcttgcgtaattatttcttttctcggaacattatagctgatttcttgtaccgaattattaaatggaagcgtttgtagcgttggggtatccagtgtatttttgcccgctctttcatgattaaaagattgaacgccaagtacggcaacgaaacaaaccgttgcagcaactgccatttgtaacattggggaaaagaatgagcgtattttttgtataaacggaagtttttccacttctgcgagtgtcggttgagactcgagagaatgttcgatttgtattttttcttcctgttcaatgagcgttcccattcttgctgtgaaatcagaacctaacagcactttactttctttgcgtataatggaacgaattaaatgataatttgaccaactattttgtaaatctttgttttgacaaagggtgtcagtaaatttgttaccacaatgctcaccatcgatataagctgaaagtaactctttttgcatctttaactccaagtctttgcttattaaactatttaacgttgtatcaaaggttgaattttgctttcgattatttctcttgcacggaaaatacgagaacgtacggttcccaccggacaatccataatttctgcaatttcttcgtaactcaatccttccatttcacgtagtgtaatagctgtttttaaatcttcttgcaggttactgatagtatcaaaaacaacttttttcaattcactggataatatttcattttcgggagtattcacgtcccttaaatttgtaccaacattataactttcagcgtcttccgctaatatatcctctgttggcggacgccgtccttgtgccgttaagtaattctttgccgtattaaccgctattcgatatagccaagtataaaaagcactttcgccacgaaatgattcaattgagcggtaggcttttataaaggattcttgtacaacatcgggaatatcgttttgtgaaatataacgagtaagtaatccagcaactttattttgataacgagcaaccaataagttaaaggcctttttatctccctgctgtactttttctaccaaagcctgatccgttagttgttcagccatataacctcttgtatcacatctaacaagccttaatattaaagccagccaacccctgtgcttgttagacgtaatggaataaaaaaagttcaatctttttaggaaagattattgatataaatttaaattttcttgaatatgatctaccatctcttgtaattcaagatcagcagccggagttttattaaaaaaccaagaaaaaagttgtaaatccgagcaagctaataaacgcaaaaatatatcttttttagcatcaggtagttcatcaaaatattgttgaaaaaaaggcataataactttatctaattccaacatgcctcggcggcaatcccattcaatgcggaatttgttgtatttttccatgcttaatttccttttatctaattttcttgttaatagtaacaatcggaagaaacgctgtaaataaaagagaagaataaactcggttcgggtagattttaggtgtgcaatataaatggcatacaaataaggcgtattatatatcaatacgcctttgctcttaggtgtaaatccctttaacttttaaccagctctactacttcacgggttaatcgtccaatttcttcccattgttgggacttaatcaaagatttctctacaaaccaagagccaccgcaagcaactacgtttggaatagcgagatagtctttgatattttgtggcgaaatgccaccggtcggcataatttgtaagttaccgtaagggccaagtaaggcttttatcattttaacaccgccacttgcctcagcagggaaaaacttgacagcttgtatgccgagttcaagagcggattcgattgccattggattatttaccccaggcgttacaggtatatttaactcttgacaatacttcacaatatttggattaaagcctggagtgacaagacaatctgctccggcgtttttggcagccaatacctgttctttggttagcaccgtgcctgcagctatgagtacttcaggatattgttggtgaaccaatttaatggcctcttcggcagcttcggagcggaaagtaatttccactacaggcaagccgttttcagacaatgtttttgctaagggtaaaatatcctctgctttatctaaagcaataaccggaacaactttaagctgtttcaacttgtcaataatttgttcagtggtataacgcatttttaacctcttttttaatgtgaaaaaatttctttaaaatggttattttatttgaaataacgttttgcattgtcatagcaaatgtctttcaccatctttcctagcaggttgagatcatttggtgcttcaccacgttcaacccagccaccaatcatttcacataaaatacggcggaaatattcgtggcgagtgtaagataagaaactgcgagaatcagtcagcataccaacaaattggcttaatagtcccaattgtgatagctgttgcagttggcgttccatgccatctttttgatcgttgaaccaccagcctgaaccgaattgaattttacctgcaatgccccctgtttggaaattaccgatcattgtgccaagcatttcgttatcacgaggatttaagcagtataaaatggttttcgggagttggtctgtttgatccatgctgtctaataaacgagaaagtgattcagcaaacgcacgatctccgattgaatcaaatccagcatctgcacctagcaatttgaacattctcgtattgttgttacgaattgctccgatatggagctgcattacccaatggtgtttgtggtactccgtacctaaccaaactaatagtgcggtgctaaattgtgcaatttcttcttcttcaataggttgattgttaagtcttttttgcaatatttgatcaagagttttctcatcaggaattggtgagaaacggacaatttccatactatgatcagcagatttacaaccatatttatcgaaatgttcaatacgtttcgatagagcctgttttagtttatcgaaagtgttgatttcaatatctgcgacttttcctaactgctcaatataatcattgaacagaggaagctcaattttaaacgcacggtcaggtcggaaacttggtacaacttcaacatcaaaggtattatcttctgcaatggctttatggtattccaatgaatcaataggatcatcggttgtaccaaccaaatttacattcatttttttcataataccacgtgctgaaaactcaggctgttgcaataactctttccctttatgccaaattttctccgctgtttcaggtgaaaaaatcgtgtcggtaataccgaacggacgacgtaattctaagtgagtccagtgataaatcgggttaccgatacattttggtacagtgttggcaaatgcgagatatttactgtacttatctgcacttcccgtaattaaatgctcttctaccccagctgaacgcattgctcgccatttgtagtgatcgccctctaaccaaatttcagctaaatcattaaattggcgattttctgcaatctcttttgggtttaaatggcagtgatagtcgaaaatcggttgtttttcagcataatcatgataaagcttttgagccgttgaggttgatagtaaaaaatcttccgtcataaatttcatcattatgtcctcttattgagttattttttgttctaatatacttgcgttttcgtccactttttctttagaaagcgggtaaacgtatttcaacagtaaaaaaatcaagatgcaagccaatgcaggtactcccgttgcaaagttatagattgactctaacacttcttgtggttgttgtgggatttttgcagaatagccaatgtaacttagtgcaaagccacctaaaccaccagctaaagcttgcccgattttgcgagcaaatgaataaactgcataaattgtgccatcttcacggcgtccagttttgataaattggttatcaataatatctgtaataaatgcccatataataatttggaaataacttagacccagtgttgcaatgagtgcaacaatgataaataaccaaacatttgtgattttaacgaagaatagcacactgtatatgacagcagttatcaataaacctacagaagctgattcttttttaccgtactttttcacaatattttgggcaaacggagcaaccataaatgttgtcacggcacctaaaataccaccaaatgacaatgctaatttactattaaagtaatcaacatacaaatatgggttcattgtaccgatgattaaggttgctagcagtaaaatgatagcgattaaaataaagataagtaacgcactgtttgagaatagactgctaaagattgcttttacgtcatctaaacagtctgatttattgtgtgatttgttgtggcgacgaccttctttttcaggcaattgaactcgctcaaccgaaaatctccaacagatttggtacaaaataaacgcacagatcataaatgctcccataatgtatgtgaacatttctgggataattacttgtttaccctcaacttctttgtaaataatgagtggaataacaaatgagataaaaagtaccgcaatatttgcaccaactgtacggaagatagataatccggcacgctcatcagcttttgtagtaatcacggaagccattgaaccataaggaatattgaccgcagtataggctaaactaccccaaactatgtaggtaacagtgatgtagaccaattttgcggtataagaccaatctttcacaatgtgcaagaaaagcagaaatcctgaaatacagataaagggagttgcccggcgaataagacctctgaaacgcccctctttaaaaggctttatagtatctactaaacgtcccataccaatatcagtaaaagcgtcaataaatctagaaactagaaatagaagaccgacaacataaccttcaatttgtagcacattagtataaaatagcattaaaaagaaggcggacatcataaaactaagatcattagcaatatcgccagccatataggcaagtttgtcttttaaaccaaaaggtctttgtgttgaactcataaaaactccttgtgaggaatatagattaaatatgggtatctttataaccgcagaacgcatcaactgggctaatacctttaaactcggaattacccattaatttttctaccagcaattctatggttggctctttgccgtcataagcattgatgtaagtttttacttgaggaacatcaactaaatggaacgggcattgaacggaaacgaaaattgttggtacttcatgtacatagaatggaatatcaggcgttcctttggtcgcttgccatacgatacgttgaactgtactcatttgcacattcgcaacattgataatcagatcataatgatccgttaatgttgtaattgggcgtttttgggagtattcattacgaatggttttgacctgatcttcgtccgacatcttgagaatattatccatcggtgatgtataaatagaaactgtaaatcctttttcttccagtttttcttttaagatttctgttgcactgcgttgactacctgcaaccattttaccgaagccaccatctgtacctttaacatttacaagtaagattctagggaaacgttcaacattaattgggaaaatatcttgtttatgtttaactaaggtaattgctttatctgcaacatcacggaaaattgctttatgttctggtagtcctatttttgctaatgcttgttcttttggttcaagcaatgtttctcttggacgattgtgtaagcctaattttgcttttaaccctagaatacgagtaagggcatcatgaaggcgttcttcggtaataatgccgtttttataaccttccatcatataaccgaaatcttcatcaggatcgttaaagaaaaggaataaatcacaacctgcagcgatagcagtcggtagcatttcgctacgcttcattgctgaagtcattgctaccatatggctggcatcagtaacaacaacaccgttgaaacctaatttacctcgtaataagtctgttaaaattggttttgaaagtgtcgctggtaggcagtcctcataagctaaatttggattgaaatgctgctcgtaagcaggtaagtgtatatgacctgccatcaacgatggtaaaccagcatcaattaagccttgataaactttgccgaaagtattgtcccactcttcgcaactaaaactgtttacactaaaagaaagatgctgatctctttcatccactccatcaccagggaaatgttttgcagccggggcaataccactttcttgaatacctttcatataagccaaggacatttctagtactttctctggatttgaaccaaatactcgattagaaataattgggtttcgccagttataactaatatcaacgataggagcaaaactccagttacaaccgatagctgctgcttcaataccagctacacgccccatttcataagcatatttagcatcatcggttgcaccgattttgacttgtaaaccaatttctgttccatcactgcaagcaccattaccaccagcttctgtattcgctgcaattaagagagggattttacttttagtttgtagaatatagttttggtcataaacctcctcagcaggaccgggattataacgtaccgcaccaatatggtaacggtttaaaacatcagtgagatattcctcggatctgcttgaacccatattcacaaaaagctgaccgattttttcttccaacgtcatattggctatagtgttttttacccattgaatatcttcatcttttaagtaataaggttttttcgttaaatcaacagacataatttctccttgcttatttgtcaaaatagtaataattgtgatcacgcggttagatttgcattaaattttgcaaccaattgggcttgatattgagaatcaaatttttggtaaaccaatttccctaatgtttctaatactaactgatcccaagattcatcttcattgccacataaaatcgggaagaaatttacacttgcttcattggcactatttaaatcacccggtgaatcaccaaccattaaaatattgttaggttgatagccatattgtgctaattggtttaaacaatgagtttttgtaccctcatcttgtccataaactagatctacaaaagggagcaaaccatgccttgtccattcatcaagaatagcctcattatttgcggaacttaccacagcgatgtctgcaaactctttaataatggcgagggaacgtttgactaaacggaatggtttatcttgagtatgtagagttttaatacccatattgactttttccgaccatgctaacgcaagttttagatcatcggtatggttgtcttgtattgcttgaataagtgaacgattggataattccgaagttgtatttacccagtgttttaattggctgaaatcctgttcataaccatactcttccaaagaaagaatcaatcctttgaatcgattgataccacgtgtttgagagtaaaggttaattctattccaaatttcaataaaacgtgcttcatctgtaagtccaaaaatttcaacagcataaggtccgaaacacttatcatgtttaatattcattgtatccattgcacaaccgtcagaatcaatgcacacaataaatttatgttttggtataaatgttgtcattattttcccctatacaccgctgtaagcagagaaaccgccatcaatcggcaatactaccccatttatgaagctggcataattttcatccattaagaataaaattccacccatcaattcatgtgcttcaccaaaacgtcccatcggagtattagttaaaattttattagctcgagctgtcggatttccttcactgtcaaaaagtaatcctctgttttggttactgactaaaaaacccggagcaatggcattacaacgaatacctactttagagaaataaacagcaagccattgggtaaagttactgatagccgcttttgctcctgaataggcaggaattttagttaacggagtataggcattcatgctagagacattaataatattagccccttttttgccgatcatatctttggcaaatacttgagtaggaagtaaagtacctaaatagttgaggttaaatacaaattcaataccatttttatctaaatcgaaaaatgattttgtactatctgctaagttaaattcatgaaattcattgtcggttgttgcttttgggctattaccaccggcaccattaatcaacacatcacaagttccaaagtctttttcgatagcatcacgagtttgttgaatactttccaaatcaagtacattggttttgtatgcttttgcaatgccaccattttgtacaatagcttgtgcatattgttctgccgattcgaggttaatatctaataaagcaacttttgctcctgtttttgctatttcttgtgcaaaaaatgcacatagcactccaccagcacctgtaataacaacgactttacctttgaaatcatgattgtttgcaatattcatatttttatctcctattaagattaattgatatgctaaatatacgtctatttttaaaactggtaaaccagttattaataaaagtgtgatttacatcacaaaatttaaacttttttggtttaccttttggttttttatgtaaaatatgcttaaattatagttgttttttggtgtgcgaaatgttaatttggtgaaccagaaaagtattttacgaacaccatcaagaagtcaaaaaagcagagagacaaaaaaatgatggcaacatcacctgaagaactacgttcttataaaaaaatagggcaagaattaaaagcggaattattgagaggaacttatggtattggggataaattaccggcagagcgtgatttatctcagtacttcaatgtcagtcgtactgttattcgtgaagcacttatcatgcttgaacttgagaatttagtcgaagtgcggaaaggatctggtgtttatgtaataaatttacctaaatcgagttcagaggaaactgaagatttgcctgatgttggaccctttgaattgctacaggcaagacaattgttagaaagtagtattgcagaatttgcagctattcaagcaactcgagctgacgttttacacttaaaagagattttagatcgtgaacgtagaactttagagtgcggtgatgatgaagattatattgcagatgaggattttcacaaagcaattgcagaaataacgcaaaatgaagtggtgatccgcatgcaaaaggatttgtgggagtaccgaattaatagtcctatgtggaaaggtctgcatgcacatatctctgatcaaagttaccgctatttatggttaaaagatcacgaaaatattattgttgcaatacagcgaaaaaatcctgtattagcacgaaaaatgatgtggcagcatttggaaaatgtaaaacagaaactgtttgaattatcggatttagatgatcctaattttgatggttatctgtttagtgttagccctttggctgctgatttttaattagatgaggaatttactatggaacaaacatggcgttggtatggaccaaatgatccggtatctttggatgatgtaagacaggctggtgcaacgggagtggtgactgcgttgcatcatattcccaacgggcaagtatggtcagttgaggaaatcaataagcgtaaagcattgttggaggaaaaagggttggtttggtcagttgtggaaagtgtacctattcacgaagatatcaaaacccaaacaggtaactatcagcaatggattgataactataagcaaacattgcgtaatctagcgagttgtggcattgacatagtatgttataactttatgccggtattagattggactcgtaccgatcttgagtatgaaatgccggatggttcaaaagcgttacgttttgatcaagtggcttttgctgcctttgaactatatattttaaaacgtccgggagcagaggaaacttactcaccggaagagcaagcagaagccaaagcctattttgatcaaatgagcgaagcggatattgcgaaattaacaaaaaatattattgctgggttaccgggatctgaagagggttatactcttgaggaatttcaagcacaacttgatcgctataaaggtatttctacagagaaattccgcactcatttagcctatttcttgaatgaaattgtgcctgttgcacaagaagtgggaatccgtatggctattcacccggatgatcctcctcgtccaattctcggtttgccacgtattgtgtcaactatagacgacatgcaatggtttgtggatactcaaccgcttgccgctaatgggttcactttctgtactggttcatatggtgtgttagcagagaatgatttagtgaaaatggcggaaaaatttgctgatcgtatttactttgttcatttgcgatccactcagcgggaggaaaatccacgaagttttcacgaagctgatcaccttgccggtgatgtaaatatgtttggggtaacgaaagcattactcaccgaagaatatcgtcgcaaggcaaatggtgataatcgcttaattccaatgcgaccagatcacggtcatcaaatgcttgatgatttgaagaaaaaaactaacccgggttattctgcaattggtcgtttaagaggtttggcagaatttcgtggtttagaattggcattaaaaaaagtgtattttaatgactaattaaagaataaaggtactaagtgtcttagctgggaagtatagttctggacatggtgtgaaagaaacccgacaaattgtcgggtttctttcatctaaaagagcggtctgttttatgctgttttgggtttgataacagaataaatgacacctgttaccaaagcacccacgctaattgcaacaagatannnnnnnnnnnnnnnnnnnnnnnnnnnnnnnntatattattttacacaaagttttaaaatttgttcgctaccctgcacgagatattgatcatcttcagatcgtactcgattatttttcaagtctaacatggcatcataaataccttgtgtcagacttgcttgatcaagatgactccaacaagttgaacttaatctattaaagttggtttgtaatccgaaagcaaagagaataccgctataataagtatgcacatcgctgtctaatccattgcgttgaaacagtttttctttaatttgattgatcgggactgaaatttttgcggagtaccaatcttttacaccactgacaaaagcgttcacatgatattctttgttcacacgaccttggtaactttgtactgccaccgcataagcagtggcataagatttttgatctattttatcattgtccaagttaatcaccgtttttatattgttttccgatgaggtataagaagtaacagattttaccgagcaagctgaaatcagcccaatacataaaaataaagatattcttttaaacataaaattattcccaaagaaaaaataaattaattgtacagacggatcggatttaagccaataaagaaaattcaccgcactttctcatttattctcaacctttaaaacaaaatctaaaaatgctatattgtacgctgttttttctgactaacctcaattatttatggctaattatcaagatataacatttgcccttgcgggtgtgtgccaagcggcaaaattagtacagcaacttgcaatgaacggtacggttgaccaagaaattttgcgaactggtttaagtacattgttgcaaactgcaccggaagatactttagccgtttatggagggcagaaaagtaatttaaaattggggttggaaaccttaatggaacaattaaacggcagtgatgtaactttaaatcgctattggttaggacttttggctttagaaggtaaattacataaaaatgcacaagctaaatctgaactggctcgtcgtattcagtatttgcctacacaacttgcccattatgatttacttgatgaacaaatgctatcaactttagcttctatttatgttgatgttatcagtcctttaggtgctcgtattcaggtccaaggctccccgctttatttacagcaattaatgacacaaaatcgtattcgtgcttgcttgttgaccggtattcgttcggcggtactttggcgacaagttggcggtacgaaatggcaatttttgttttcacgtcgcaagctggtagcaacagcacaacaaatttattcatctatttaactgttcttaggagtaattcttttatgcaattcaacgcattgaccgcactttccccgatagatggtcgttatcaagacaaagtaactgctttacgtagcatttttagcgaattcggtttattgaaatttcgtgtaactgtcgaagttcgttggttacaaaaattatctgcaacaggcactattcaagaagtttcttctttatctaaagaggcaaacgattacttaaatcaattggtagaaaatttcagtttgcaagatgctgaacgcattaaagaaattgaacgtattacaaatcatgatgtaaaagcggttgaatatttcttaaaagaaaaaagtctggcaatacctgaattagtggcgattagtgagtttatccattttgcttgtacttcggaggatatcaacaatctttcttatgcgttaatgttaaaaaacgcacgtgatgaagtacttttacctgagtggcgtaagttgattgatgaaatcactcgtcttgctacagagtataaagcaattccattattatcccgcactcatggacaacctgcctcacctaccacaataggtaaagaaatggcgaatgtggtatatcgcttacaacgtcagtttaaacagttacaacacgtggaaattctaggcaaaattaatggtgcggtaggaaattataatgcccatttatctgcctatcctgagattgattggcatcaatttagccaagaatttgttacctcattaggtttaacttggaatccttatacgacccaaattgaacctcatgattacattgcggagttttttgataatgtagctcgttttaacactattattatcgattttgaccgtgatttatgggggtatattgccttaaatcatttcaaacaacgtactattgccggtgaaattggatcgtctactatgccgcacaaagtgaatccgattgattttgaaaattcagaaggtaaccttggcttagcgaatgctgttatgtcgcatttaggtgcaaaattaccgatttcacgttggcaacgtgatttaaccgactcgacagttttacgcaatttaggtgtggggcttggttattgtttaattgcttatgcggcaacattaaaaggtatcagcaaacttgaggtaaatgaaccgcacttacgtgaagaattaaatcaaaattgggaagtgctggctgaaccaattcaaactgtgatgcgtcgttatggtattgaaaaaccttatgaaaagctaaaggagttgacgcgaggtaagcgtgttaatgcagaggcgatgcgtgagtttattgagaagttggaaattccagctcatgaaaaagctcgtttaaaacaacttacaccggaaacgtatatcggtagtgcaattagtttggtggaaaaattgtaaattcggtgtgtttgtcttggctattgccccttagtataaaagcgtatcttagctacgtaaggggcaaatttaagacacttcaggtaagatttaattcaaaaatagacttttgccggttaagtttaaaaccttctcttattaataattccggttgttgcagattttgttccatgactaaaagtgtcgattgagtataactgacaaattcttttgcttttgcaataagtgcggtgtaaatttcactcttattttgggtatttttgacaaaaatatcatttaattgccaataacgttgcagttgtaatgaagaaaagcgaggatagagttgaataaagccgacagggttttgctgattatcgacggcgagaaagaagatactttcactaaatcgaattcggtttgataaaaaaataagagttcgctccggattttctatcatattatgggtgaggcggtattgttcaaataaagacaataaagcgtccaaattccatagttcagctttaaatattttcatttctcaataattgttcaaaatttatgaaattcatacagtagattttatctttttaatacaaaataatcatcttttatgaaaaaatttttatggatacaggaaaatttttgcaaaaaagagtatagtactgacagaatttttttattaattattatggagaacataaaatggctcgtcgtcctttagtcatgggtaactggaaattaaatggtagtaaagcctttacaaaagaacttattaccggtttaaaagatgaacttaatgcggtgtcaggctgtgatgtggcaattgcaccgcctgtcatgtatttagcggaagctgaaactgcactggtcagcagtgatattgctttaggtactcaaaatgttgatttaaacaaacaaggtgcatttaccggtgatatttcaacagaaatgttaaaagactttggtgtaaaatatgtcattatcggtcattctgagcgacgtcaatatcatcatgaaagtgatgaatttattgcgaaaaaatttggtgtgttaaaagatgctggtttagttcctgtattatgtatcggtgaaagcgaagctgaaaatgaagcaggcaaaacggaagaggtttgtgcacgtcaaattgatgcggtgatgaatacactaggtgttgaagcatttaacggtgcagtaatcgcttatgaaccgatttgggctatcggtacaggtaaatcggcgactccagctcaagcacaagcagtacatgcctttattcgaggtcatattgcaaaacaaagccaagccgttgctgaacgggtaattattcaatatggcggttccgtcaatgatgcaaatgcagcagaattgtttactcagcctgatattgatggtgcattagttggtggtgcatcgttaaaagcgtcagcgttcgctgtcattgttaaagcggcagcgaaagcaaaaaactgattttagttcattcataaaaagtgcggtaattgataccgcactttttagtattcatattagtattcataatttctcgttttcttaatgtctaaaatttatgtggtcttttttttatacctcaataatgtactgtattcagccatttgtcttggtgtataaccttatacgcagttttaagtcgccgaattatcgaaaacgtattttagaacgttacgctttttatccttcgctgactgaaccgaagccgaatggggttgtgattcatgcggcttctgtgggggaagtgattgcggcaactcctttagttaaaaagatacaacagcaatatccacatttatctataacgtttacaacggtgacaccaacgggatcagatcgtgtcaaagccgcttttggtcaatccgtcttccatgtttatttaccttatgatttacctgatgcaattttgcgttttattgattttgtaaaaccgaaaatgtgcattgtgattgaaacggaaatttggccgaatttaattaaacaattatatttacgagatattccttttgttattgctaatgcaagattgtctgaacgttcggcaaaacgctatggctgggttaaagcacaattacaaaatatgtttagtcagattagcctgattgcaccgcaagacgaggtaagcctgcggcgttatattgatttgggctacaatccgtcaaaattaaaattgacgggaaatatcaaatatgacttagtggtgaatgatgaattagtgcaaaaaattaccgcacttcgtcaatcttggagtcaaaatcgcccgatttggattgcggcaagcacccatgagggcgaggaagttattattttgcaggctcatcaaaagttgctaaaaacttatccgcagttgttattaattttagtacctcgtcatcctgaacgttttaaccttgtcgcagagttaattgaaaagcaaaagcttagctatattcgccgttctgcacatgttaatcccgatttattaacacaggttgtacttggagataccatgggggagttgatgttaatgtacggtatttccgatattgcctttgtggggggaagtttagttaagcatggggggcataatcctttagagcctctcgcttttaagttacctgtgattagcggtcaatatacttttaattttccggtggtttaccaaaacttatcagaggttcaaggggtagtgttagtcaatgaaaatagccaagagctggaaagtgcggtaaaaaatttgttatcttctcctgaagtatgtgaacgctatggtaatgctggttatgaagtattggtccaaaatcgtggtgcattacaacgactatttgaattactacagccttatttggagaaagaataatgacaacggttatttatcctggcacttttgatcctattaccaatggacatatggatattattcagcgtagtgcggtcttatttagcaaagttattgttgctgtggcaaaaaacccgagtaaacaacctttatttaatttagctgagcgagttgaattagttcaattgtctgttgttcatttagacaatgtagaggtaatagggtttgatgatttattggcaaatgtggttaaagcaagacaaattgatgcgattattcgaggggtacgcacgacaatggattttgaatatgaatcacaacttgcacatttaaatcgtttgttgacgaatggtgtagaaagtttatttttacccccgaccgagcagtggtcttatgtttcttcaactattgtacgagatatttttttacatcaaggtgatgtgtcccgattagttcctgcagcggtattacgagctttagaaaagcgggctaaataatttgatgagattttattaaataatccttacattatgtatgtttaaaacactaaaactaaataggaaataatgaatgttgaataaaatttttgtgtggtttgaaagtcgtttaaatccttatccggaacagacgttcaatcacctacatcaaggtctgtttcgatttatttggtcaaatttggaaggaatgaaaaaatggattttcctacttgctttcttatcgttcggattgggggcaatggaggcaatccttttccaatttatgggcgttttggtggaatggctcagtcaatatgacgtgcaaactttatgggtagaaaaaggtgcttatttagttgggatgttgattttattgctatttagcattatatggtcttttttagcatcagctacacgtttgcaaaccttacaaggtgtttttccaatgcgtttgcgttggaattttcatcgtttgatgttggggcaaagtttaagtttttatcaagatgaatttgccggtcgagtgtctgcaaaagtcatgcaaacagcgttggcattgcgtgatacagtgcttactttggcagacatgatggtttatattttggtctattttgttacctcaggtattgttttagcagcattagatatatggttattagttccttttgttctatggctaatagtttttgtggttattttatggattgttattcctgaattggctaaaaaagcagaacaacaagcggactcaagatcattaatgacaggtagaattactgatgcttatgccaatatttccactgttaagcttttttctcatggtgcaagagaggcagcttatgcaaagcgatccatgcaagattttatgatgactgttcatgcacaaatgcgtcttgctacttccttagatactctgacttatagcacaaatgtagcgttaaccttaagtacgggaattctagggattgtgttatggggaaaagggttggttggtgtgggtgcaattgctactgcgttggcaatggcactaagagtgaatggattatctcgttggattatgtgggaaatggcacgcttgtttgaaaatatcggtactgtaaatgatggtatgtcaacactgacaaaaccgctaactattgtggataaaccggacgcacaagatttggagattaaacaaggaaatattcattttaataatgtagactttgcttatacaccggataagcctttactaacaaattttaatttacatattaaagccggagagaaagtagggctgattggtcgttccggagcaggaaagtctacaattgtaaatttattactgcgattttatgaaactcagcaaggttctatcactattgacgggcagagtgtcgcagatgtttcacaagaaagtttacgtcgccaaattggtttggtcacacaagatacttctttattgcatcgttctgttcgggataatattgtttacggtcgtccggaagcgacagaagaagaaatggttgaagctgcaaagcgagcagaggcggcggagtttattccatttttgagtgattctcaagggagacaaggttatgatgctcatgtgggagagcgaggagtaaaactttctggggggcaacgtcagcgtattgctattgctcgagtgatgttaaaagatgcaccgattttgttactggatgaagcaaccagtgcgttagattctgaagtggaaatcgctattcagaatagtttggacaaaatgatggaaaataaaacagtgattgccattgctcatcgtttatctacaattgctgccatggatagattaattgtattagatcaaggacgaattgttgagcaaggcactcatactgaattgctggagaaaaacggtttgtatgcaaagctttggcaacatcagagcggtggatttttgagtgaatattagtcaagattttaggattaatcaaagacactaaaaaggcggaaatgtaagatttcaaattccgccttttgctcctcaaacagtgttatttaaatttgtcggcataagcagagctgttgatccactgatgatcttgttcccaagtaaatttccatttacgtacaggtcccgccataacattaaggtaatagttgttataaccggcgatagtggcaactgggtgataaccttttggtaccagcaccacatcgccatcatataccgccatacattcgtccaaagtgcggtcgtccgtatagacacgttgcagagcaaaaccttgtggtttatcaaaacgatgataataactttcttctaagtaagtttcatcaggactatctttttggtcatgcttgtggcttgggtaggaactggtatttccttcatcagtaaatacttcaaccactagcaaggcatctgccttttcggtttccggcaagatattgtgtacaaggcgtttgttattaccaaaaccacgtcgttctactcccacttgttcaggggtaattaaacgtacaggcaagtcaccgttacttggtgctcgacaaacagccaactctaaataagtttcagctttaatttctatttgttgatggtgtggagcgtacaccgaataaggcggaattttctcaaacggtgtagttcgattaccaatattattatatgtttcaccgccagctaagacagtggctttaccacttactaaaacaaaacaagtctcagtagtttctgtattaaaacttaatgtctgccctgcttgcaaatgatacatttcaaaaccgacatattcccaacctgcactttttggtgtgattttttgtacttcaccatttgcagcaggattgtctttgcgtgatttagataataagtaactcatattttccccaaagtgatcatattgataaaattttgccgaaatcataccgcacttagtaaatttcgctatgaaaaatatataaaaaccagatgtagatcacaaaataattattttacttctattagaatttgataaaaatgttttatttatgattttttttgcagtatataaactaggcattttataggatttagtagtatagaaatctttgttaattaaaaataaaggagttttgtatgaacagttttttgcaaaaatatgggtttaccccagcctcattttttcaactcattctgatcactgttaatgcacaattgatttatgctttttgggatattcgtaatagcgtacctggtggttttcctgccgctttaggggtaacggatcaacaagccggttatttatattctatgcaaggacttgtgattattttagggactattgctttaggttgggttggtgaccgtttttcaattcgttctattatgttgctatctacggttggtgtgggtggaatttctttatttctaaccctctcatctccaggacttagcatgcctgtgttactggcttgtttcttctctatgttattttttagtgaggtattatttaaaccggctaatttcaaagcattaagaatttcaaccacggaaaaacatcaaggtatggtatttggattatttgagtttggtcgtgggttgcttgctttccttatctccttgttatggacggtgatgctttattataaagtcggtccgaaggcaatgatgatgacaagttgtattattgttattattactggtattgcagtgttttttattgtacctaaagatcaaaaagtcggagatgaagatactcaagttaatacgaccaaagaagctattcagggtgttgctcgtgtagctaaattaccggttgtttggattgccggaattaatgtgttctgtatttatggtgcgtttgttgccgctgggacctattttgcccgttttttacaaggtggatatggtacaagtgcggttgctgcggcagtttttgcaacagtagttattgcattgagaatgttacctttggtttcttccgttttagtagaaaaagtctttgcttctaccgcacacttcatgcgaatgatgcaaattattttagtggttattctttctgtaattggaattatcttttttaccaatcatccagatatttctttatatgctgatggttatattccagataataccccagtaggactcatttcttccagtatgttctggacactggtagttcttatgttatgtgcatcagcttgtatcttcatgattcgaggtgtttattatgccccaatcggtgagatgggggttgataaaaagcattcctcagcagcaatgtctttcgccattactattggctattttcctgctttattagcaccaattgtattaggtggcttggttaaatcaccggcaaaagatgctacaggacaaattatccgctcttatttaactgatacgcaagtgttagcttgtgctttctttgggcttgcgattcttgcgttaatttctgtttttatgtcacatactttaattaaaatgaaacagaaacagcaattaaaaactagtaatcaataggcggttttttatgaatggtcaaaaaataataggaagtcagtgtattacgcaatgtaatcccgatcttcgcattaccgaattgattattccaggaactcatgactctgccacatcaacgtgttatgaacgttattatcgaacacaggatttatcaatagcggagcaattggattgcggtgttagatttttagacattcgtttacgcaaagaaatggttgcagcccatcgagaatgggttagtgatattcgagcagaggaaatttttgaaaagtgcggtgagtttttacaaaaaaatccacaggaattcgttttaatgcgtattcaaaatgcaaatgaacggaaagatgattttcctgaatatggcgaagcgttgttgtcaaaagtacagcaatataaatctttgttttatgcttgggatcattctcaaattgttcaagatggcaatccaaaatggccaactattgcacaagcggctggaaaaattgttccgatcgaatgtgctccgccaagtatgtcaattaacaaaatagacggtgaattatgggcagccaattggcatgataattcgcagattttgttacaagacttgtgggatggtccgacagtagaagaaaaatgtgtggcaattaaaacgctgattgaaaaaggcagagaggtacactcggacatactgttgttaaatcatattagtgcgactaatggtgaattgcagtatccggatgcttatgcagcatatttgaatgaatactctagtcgattatggaaacaattggcgaaacgtagttttagaggtgtgcagatttatgattttattaatccttctatctgccaagaattgttgcgattaaattttgattagttgagttgatagatttagcaaaaatcaaatctagatcacaaaaatgaaataaatatttcgttttcaataaaatgaattgaaaattttattccattgatctactctaaagacgtagcaagaaatgctttgtgattgagcaaaaatacttaaggagaaaataatggaaacggttttgaactttatcaatggtaaacaagtagcaagtaaaggtactaaagcttggcctatttataatccagccacgggtgagcaaattcgccaagtaatgatgagtactgcagaagaggtaaatgaagcggttgaagttgcacaaaaggcatttcctgcttgggctgcgacttcgccacttcgtcgtgcccgtgtaatgtttaaatttaaacaattgttagaacgtgattgggatgacttagctcgtttaattaccgaagaacatggtaaagttttctctgatgcacaaggtgaactaactcgtggtttagaagttgtggagtttgcttgtggcattccacatttagtaaaaggtgaattttctgaacaagccggtcgtgggattgatattcattcagccatgcaacctttaggagtttgtgtaggtatcacaccatttaattttcctgcgatggttccaatgtggatgtttccgattgcacttgcttgcggtaatacatttatcttaaaaccggcgaaagccgatccatctttatctattcgtttggctgaattattaaaagaggcggggttaccggatggtgtgtttaatgtagtgcatggtgatcgtcaagacaatgaaattttattgcgtgatcctcgagtgaaagctgtaagctttgtgggttcaactacggctgcggcacatgttcatgcgattggttcggcacatggtaaacgtgttcaagcactgggtgcggcgaaaaatcacggtttagtgatgccagatgtcgatattgaagcaacagctaacgcactattaggtgcggcattcggtgcagccggtgaacgctgtatggcattacctttagcagtaaccattgatgatgaaacggcagataaattagtcgcagcattaaaaccgaaagtagaggcattacgttatggtcccggtctcactaaagaaggcgaaaaagaaaatgattttggtccattaattactcgtcaacatcgtgataacgtaaaacgttatgtagatataggtgtgtcagagggggcaactttagtggttgatggacgtgataaattccctaccggttacgagaatggtttctttattggagggtgtttatttgaccatgtaactcctgatatgactatttacaaagaagaaatttttggtccagtattaggcattgtccgtgcgaaaaatttccaagaggctatgaaactaattaatgagcatcaattcggtaatggtgcagcaatctttaccaataatggtgcggcagctcgtgaatttgcatatcaagtacaagcaggtatggtgggcgtgaatgtgccaattccggtgccgatggcattccattgtttcgggggatggaaagaatccgcttacggtgcattaaatgcttacggtccagacggtgttcgtttttatactaaaatgaaaactgtaacaactcgttggccagagaaagatctttcatcacaagcagcattcagtatgccaaccctataaactagacaacagaataaaaatttaagttaatgtaaagaagatagttttttagctatcttcttttgcaagaaaaggaaatgaaaatgaaaaaagtccgagtcggtttaatcggaacaggttatattggtcgttgtcatgcgattgcttatgcacaagcaccgacagtttttcctcttgaggctgaattggttttggaatatttagctgaaatcacaccagaactggcacaacaaaaagcacaagaatttggttttaatcgttcgacaggtgactggcgagatgtagtatccgatccaaatatagatgttgttgatatttgtacccccaatttcttgcacaaagaaattgctttagccgctattgctaatggtaaacatgtttattctgaaaaacccttagcattaaccgcagttgatgcaaaaatcatgtatgaggcggcaaaaaaagcaggtgtcagaacccttgtgggatttaattatattaaaaatccgactacacaacttgctcgtgaaattattgagcgtggcgaaattggtgaagtaatccatttctatggtacgcataatgaagactatttagcatcagatacgacacccttagactggcattgtgttcgtgaaaaagcaggacttggtgcattaggtgatttggcagcacacattgtgcaaatgtcacaatatttagtaggtagcgatattgaaaaagtgatcggtgatatggagacggtagttaaagaacgcccaaatcctcaaaatcttgcagagcgtttaccggtagaaaacgaagatcaagcaactgctatggtgcgttttgcaaacggttgtatgggaaccattgaaacgtctcgtattgcttgtggacgtaaaatgggattgacttatgtaattaccggaacaaaaggtacaattacctacacacaagaacgtatggcagagttaaaactctatcttcacgatgaagatcctgctcgtcaaggctttaaaacaattttgacaggtccgttacacgcagattataaaaatttctgtgtaagtgcgggtcatggtattggttttaatgatcaaaaaacggttgaaattcgtgatttagtgaatggaatagcgaataatcataatatgtatcctgactttgaagaaggttttaaagtttctcgtgtattagatgctattgcacaatcttgccaagaaagacgttgggttaacgtgaaagaaattgcgtaattttcaccgcacttttataagtatttaaaaaggtcgagttgaatgactcggcattttttaggtataaatttaaaatgttgtttatctctaatttttaaaaatttttccctcaaaaagtagatcttgttcacaaaattttaacttcatcattgctctgtatcttgataaatgttacatactgttttaaacaatttatttcaaattgttttatttttggaatttatatttcttcaagtggaatatagctgtatttcagaatagtgattaactcaactttccaggagtagcgttcttatgaagaaaacattattggctatgttatgtggcggtctattattaacctctcaagctgtaatcgcaaaaaattatgtcattggtgcacctatgaactcttttgcggataaatggcaaacttatcttcaagatgccgttcgtgattttgatgaaaaacatgatgatgtgcaaatcaaattggctgattcaaatagcgatcctaatattcaagtcaatttagttcagaattttatcgaccaaaatgttgatgcgttacttgtggttccaaccgatccgacagtagtgaaacgtattggcgtattggcaaaaaaagcgggaattcctttaatcgtggtgaaccgtaaaccaaatgatgagcatatgaaatatgtaaccagctttgttggttccgatgaaattgaaggtggtcgaattcaaggtgattttattgcgaatactctagccggtaaaaatgcagaaagtctcattttacttggaccattgggacaagatgcggtaactaaacgtactcaaggtaatgaggaaatttttgctcagcacaagaatattaaagtagtgagcaagcaagaaggtagatgggaacgtgaccgtggtttagctattgcagaaaacgtattggcggggaataaaggtattaacgttattgtgagtaacaatgatgaaatggctattggtgcaattcttgcaactcgtaagttaggtatcaaagacgaagacattactatcgttggtttagatgcaactcccgatgcgttagagtatttaggtaaaggtttggatgcgacagtattccaatccgcacaaggtcaaggttacaccggagctgaaatggcttatttagcggctaaaggtgaaaaagtaccaagcgttaaatgggttccatttgagctagttactccggataaaaaagaagaatatcaagcaagatataaatagacgcttcttaaccaacacaaagggtagtgtaatacctaccctttatcttgagcaaatgttgatcgttatcatctagagacaaagttatgttcaaaaaatcattgtttgttttattgggagtagcgtcgttgttttcccccattgttacggcaaaaaatttaaccgttggcgtggcgatgtatagtctttcagataaatatcctacctatttgcaagatgctatgaagaaatttgatcaggaaaaagatgatgtcagtttccggtatgctgatgccaattcagatcctgcaagaatgttaagtgatattgaaacatttattgattctggtgtagatgctttgttagttatgccgacagatagcgatattattaaagctattggtgttaaggcaaaaaaggcaaaaattccgttagttgtggtgacaaataagcctaaagatgaggatatgaaatatatcaccagttacgtagggtcagaagagattactggtggtgaaatgcaggcaaactttattgtagaacaattaaaaggtaagccggcaaatgcgattattttaatgggacctctaggttgggatgctcaaattaaacgcactgaaggaaatgaaaatattctgagaaaacaccctgaaattcaggtgatcagtaaacaggaaggtaaatgggatagagcaaaagcaattgatattacagaaaatttgttatcaggtagtcaaaaaattgatgtagtgatcagtaataatgacgagatggcaatcggtgcactccttgcagcccgtaaaaaagggattgcagacgaggatatgttgattgttggattagatgcaacacctgatgcgttagagtatttaggtaaaggtttggatgcgacaatttatcaatctgcttccggtcaagggcgtaccagtgcagaaatagcgtataaagcggcaaaaggtgaaagtgtacctaagttgaactttattccttttgaattggttacaccggataaaaaagcacaatatattgataaatatagatgatagaaaacagtaaaaattaaccgctctttgttgttagaaattaccgttattaatacgacaataaaaataaggagttctaaatgaatgatttgagtcgttctccatatattttagagatgcggaatgtatctaaaacattccccggcgttaaagcattggacggcattaacttaaaagtcaagcgtggaaccattcatgccttaatgggggaaaacggtgcaggtaaatcaacgttaatgaaaattctctacggcatctatacgccggatgccggcggagaattaattttagatgataagccttttaaaccgagtgcaccgattgatgctattcgcaccggtttgacaatggtaccacaagaaatttctccggcagggaatttaactattgcagataacttctatcttggacgagaaattactcgcagtaaattctttttaaatcaaaaagaaatggattgtaaagcaacggaaatcttaaatgaattgggtattccgatggatgtaactgcgaaaatgtcagatgtttccgtagcgaaggcacaattggttgcaattgctaccgcagtttccaatgatgcgaaagtaattatcatggatgagccgacaacggcattaacggaggtagaggttgaacaactttataaaattattgagacggtaaaacaacgagggatcgcaattatctttatttcgcataagttagatgaagtttttcgtgtttctgatgaaatcactgtaattcgtgacggtcaatatgtaggcacgaaaccaacctcagatgtaactaaagatgaattgatttctatgatggttggtcgtgatatgtcagaaatgttccaacgtgaacgtattgcaatttctgatgaagttgtacttgaaattaaaaacttctctcgtgcaggtaaatatcatgatattaactttcaagtgcgtaaaggtgagatctttggtattgccggtttagtcggtgcggggcgttctgagattgtagagggattgtttggttataaactggctgatagtggtgaaatctatgttcacggcgaaaaagcagatattaaaaccccgttagatgctatgaaatacaaaattggctttgtaacggaagatcgtaagttaacaggactgtttttaaatttaagtattactgacaatatgattatgcctagaatgtccccttacttggaaaattttttagtgtcggtgacaaaagcacagaagtcagcaaatgctcaaaaagataaattaaaaattaaagcaccaaatgttgaggtcattaccaataatttatctgggggtaatcagcaaaaagttttattggctcgttggttattacttgagccggatattttaattttagatgaaccaacaaaaggtattgatgttggggcaaaagctgagctttataaactcatggtggaattagcaaaacaaggtaagagtattatcatgattacatcagatatgcttgaattgctttcgatgagtgacagagtgatggtaatgcacgaaggtcgtgtagccggaattattccacaagaagaattgacccaagaacgggtgcttgaattagcatccggtttaggtcaagtataaaaagatttcccctagaataacaatcgaggtatttattatgtcaaatgctacgcttaaaaaaatattgaacgcctatggaatggtgtttattttaattgccttatttttagcattatctgcatcaattgatggtttcttttccgctcgtactgtttggagtattattgagcaagtttctatgtttgggatcattgcaattggggtaacctttgccattattaccacaggtattgacttatcctctggttcaatggtagcgatgacttctgttgtggctgcttctatcgtaaccggtggcgatacagtaagttcggcattacttgcttttgcgatttcaattgtattaggtgctgcaatgggggctatcaatggtagtttaaccgcttttggctctatccctccgtttattgctactttaggtatgatgattattgcccgtggtggtgctcaactttattcttcaggtcgtccaattgatgcctcttctgaatcatttacttggatttctgatgttgatttctttggattacccggtttagtacttgtttatatcgtaattgtcattgcttcacacattttactgagtcgttcaacatttgggcgtcacgtttatgcagttggtggtaatttaaacgcagcaaaaatttgtggtattaatacaactaaaacattgatttgggtctatgttttcgccggtgccttgtctggactagtgggtgcattactggcagctcgtacttatgcaggtaacccctcttatggtttatcttgggagcttgatgcaattgccgcggcagtgatcggtggggtatcgctaagtggcggtattggtacaatccctatgtgcgttatcggtgctttaattattgggacaacaaacaaaggattaaatatgctgggagttgatccatattggcaacaaattattaaaggtttgattattgttgttgcggtattaatcgatacattaaaacgccgtagaaaagcaaattaagcaaaaggttacaagaaaaaaatagcaattgtatagttgctattttttttgtttgttggggaagtgcggttagaaaaatttgatcagctccacaaaaatgaaatttatttttcatttttattttatttgaaacgaaaatatgattatatagctacaaatttcaattatctgatttgggagatgatgatgaagacagtgagattaacggtagctcaagcattagtaaaatttcttgataaccaatatattgagttcgatggaaaggtaacaaaattcgttgaaggcattttcgggatttttggacatggtaacgtgctgggtttaggtcaagcactggaacaggatagtggcgaattgattgtgcgtcaaggacgtaacgagcaaggcatggctcatgtagcaatagggtttgcgaagcaaaaattacgcaaacaaatctatgcctgtacttcatctgttggtccgggggctgcaaatatgattacagcagctgcaacagcaacggcaaatcgtattccacttcttttattacctggtgatgtttttgctactcgtcaaccagaccctgtgttgcaacaaattgaacaaacttatgatttaagtattagtaccaatgatgcttttcgtgcggtaagtaaatactgggatcgtgtaagtcgtcctgaacaattaatgacagcttgtatcaatgcaatgcgtgtattgactgatcctgcagaaaccggtgcggtgacaattgcattgccacaagatgttcagactgaagcttatgattttcctgagtattttttacaaaaacgtattcatcgcattgagcgtatgcctccaacggaagcgatgctacaagatgctttgaccttaattcaaaatgcgaaaaaaccactaattatttgtggtggtggagtgcggtactctgaggcggcagagcaattaaaagcctttgctgaaatttataatattccatttgcagagactcaagcgggtaaaagtgcggtagtttctgagcattatttgaatgttggcggtataggtgtaacaggttgtgtagctgcaaatttattagcaccggaggctgatttagtcattggtattggtacaagatatactgattttacgacgggatctaaatggattttcaataatgacgaagtgaaattcttaaatatcaacgttgctcgctttgatgcttataagttagatggtgtacaagttacagctgatgccaaagaaacgctggaaaaattaaccgcacttttagctacaacaggttatcaagcccaatggggtgataaagtggcacaggcaaaaaaagcgttggaaactgaattagagcgtgttcacaatataacttataccgaagattttgtacctgaaattgatgatcgtttaaatcgtgaggcggtttatgctgaatttatcggtatgactaaatcttgtttagcacaaacgagagtattaggtattttaaatgaaacattaggtgaagatgatgtcatcgtgggggctgcgggtagtttaccaggagatttgcaacgtatttggcagtctaaaggcgaaaatacctatcatttggaatacggttattcttgtatggggtatgaagttagtgctgctctaggggtcaaaattgcagaacctcatcgtgaagtttatgccttattaggtgatggatcttacatgatgttgcattctgaactggtaacgtcaattcaagaaaatagaaaaattaacgtaatattattcgataatatgacaaacggttgtatcaataacttacaaattggccatggtatggacagttttgcaacggaatttcgttttagaaacaagaataccaataaattagatgggggctttgtaccggttaattttgctatgaatgccgcatcttacggttgcaaaacttatcaagtaactaccgaagaagagctacgattggctttggctgatgcaaaaaaacaacaggtttctactttaattgatattaaggttttaccaaaaacgatggcgaagggatatgacagctggtggcacgttggtgtggctgaggtgtcaaataaagctgaaattaatgctgcctatgaagattctgttgctcatattgaggtagcaagacgttactaatttaacttgataggctcaatattgagcccatttatcatgaaattcattcattctttttaagaaggacaacagtatgaaagctgaaaatgtaaaattgggcattgcaccgattggttggacaaatgacgatttaccggaaattggtaaagagaatacttttgaacagtgcgtaagtgaaatggcattagctgggttcaccggtagcgaagtgggaagtaaatatccacgtgatattgacgttttgaaacgtaaactggatttacggggtatccaaatttgtaacgcatggttcagtacattctttgttgatggtaaaaaagaagaaactatcaaaggttttatagagcatcgtgattttttacatgctatgggcgctaaggttattggttgctctgagcaaagtcgtagtattcaaggtcagaaaaaagcaattttcaaagagaaaactattttcacggaagctgaatggcaattgctagcggaaggttataatgagcttgcaaaattagccgcagaaaaaggcatgaaggtatgcttacatcaccatatgggaactggtattcaaacacccgcagaaattgataaatacatggaaatcactaatgatgatgtgtatttattattcgattcaggtcacctttattattcagaaggctcacaacaagttatgttggaggtattagaaaaatatattcaccgtgttgttcatgttcacctaaaagatgtgcgtgatgaggttgtggcggaagtaaaagcaaaagatcttagtttcttggaaggggttgttaaaggtacattcactgtgccgggagatggtgtaattgatttcaaaccgatttttgatattttagaaaaatatgattataaaggttggatggttgttgaagccgaacaagatccggcaattgcaaatccgttagaatatgcaattaaaggtcgtcaatatatcagagaagttgcaggagtttaaaatgattaaagtaggtattattggtgcaggtcgtattggtcgtgtacactcagaaagtattacaaaatatgtaaaaggtgctgaaatcaaagcgatttctgatgttcgtgttactgaagagttaaaagaatgggcaaagggaatgggtattccgaatgtctatgaagactataaattaattttacaagatgcggagattgatgctgttttagtctgttcttccactaatacgcatgcaccgatttctattgaagcggctcgtgcgggtaaacatattttctgtgaaaaaccaattgacgcagatgttgatcgtattcaacaagtattagcagaagtggaaaaagcgggtgttaaattccaagtcggttttaaccgccgttttgaccataatttcaaagcaattaagaatgcggtagtcaatggtgatattggtgaaccccacgttattcgagtcacttctcgtgatccagatgcaccgccaattgaatatgtaaaagtgtccggcggtatgttatttgatatgacaatccatgattttgatatggtgcgttatttgtccggcagtgaagtaacggaggtgtatgcggcaggaggtgttcttgttgatccgaaaattggtgaagcgggcgatattgataccgcagttattaccttaaaacttgcaaacggggcaattgcagtgattgataatagccgtaaagcagtttatggttatgaccaacgtgcagaagtattcggttctaaaggtgcgatccaaaccgcaaatgatacgccgtcaacagcaattttatctaatgtgaatggtgtcatcgcagaaaaaccaaaatatttcttcttagaacgttacatgcaatcttttgctgatgaaatggcgtgctttgttgactcagtggtgaatgacaaaccaacattggtaaacggtactgacggtttgcaaccggtattaatcgcaattgcagcgaaaaaatcattggatgaagggcgtcctgttaaaatgagtgaaatttcctagtttaaggagattgcacgaaaaagggcggtaaaattaccgctcttttggtttgtacttctgttacgttgccaaatctccgaaacagacctgtaatgcggtgattgcactaagtgcggcagtttctgtacgtagaacacgcttaccaagtaaaatttcagtaaatccctgagtttctgtttgactaatttcttgtgcagaaagtcctccttctggacctattaacaagcgaacaccttgtgggggaatttcaggtaaggtacgaattgtatatttagctcttgggtgaagattaagctttaaggttccgtcttgttcagcacaccaatcttgcaatttcattaatgggcgaatttcaggcactatattacgcccacattgttcacaagcggaaatcgcaattttttgccattgttggatttttttctccatacgatccttatcaagttttactccacaacgttcagaccataatggcgtaattatgttgacccctaactcaacggatttttgaatagtaaactccattctttctccacgagaaatcacttgacctagatgaataaataatggactttcacgattgtccaattgacgagagagaatgttaacttcaattgcttttttatttgtttgagtaataatggcagggtaaatatggttacttccgtcaaataattcaatttgctcacctacctgcatgcgtagaacacgccctacatgatttgccgcatcatcgcttaattgacaagtttgttgattttctaaagaggttggatgataaattcgaggaatacgcatattatttaatgggttagttaattttgttgctatgataacagaaattaaaagtgcggtgaaattcaccgcactttttgtcattgtatttgttgacttgaaaaaataagtaattttaccttatttttttatatcaaatttataagaaataaatccatatagcgtccaaccgatgaatgttacgattgaaccgtatagcatagcttgctcacctgctgcgtataaggcatataaactatataacgaaccgatgaaggcaacaaatgtggtaattttagctttatttaatgctactttttctactttaagtaagaccattaatgcagccattgataacagataaggtattacgttggtcaccaccgccaaatctactaagatgttaaattgtttgtttaaagatggactgatagtcatcagtgctaataaactttgaattgcagtaattgtaaccataccaataataggtgcgtttttactggtcacttttttgaagaatgctgggaaatatccttcttcggctgaagatttgaatacttgagcaatggtaaactgccagcctaataatgaaccgaagcaggacattaccattaaacccattaccactttacctgttgtttcttcaaacatatgtgcaaaagctaaaccgaacggtgctgttgaattagcaagttccaaattaggaacaataccggcaattacgttggtggaaacaatataaataaccgccgcacctaatgttccgccaagaactgcgataggaacatttctttcaggattttctactacatcagtattcgcacaagctgactctaaacctaagaatgcccataacgtcatagaaatagatacgccgatggcttcaaaagtgggaacgttatgtgggttccaagcactgacatacatttcaccactaaaccagaaccaaccaattaaacaaatccctacgaccggaataattactccccagatagtaaaagagctgatgttaccagtgattcttgccccaccaaaattcaaaacagttgctaaccatagtgtgaatatagtgcatagtgcaatggatatcggtgataaagtgacatttaatagctctgatccgtatccaacggcggatattgcaatcgcagtattggcaatgactagagaaaccccataagtgtagtttgccataaagttaccggctttaccgaaagaatattccgcataaccacccataccgcctgattttttactgaacataccacattgagcaaaagcataggctaaagcagttgaaccaacagctgtgactaaccaagatacaattgagatagttccaatttcagctaattttgtcggtagcatgataatgcctgaacccatcatatttaccattgtcagtatagtgagttgtactacaccgattttattacttttttgagtactcataattttatccctctattaaagtgcggttatttgtaattaaccgcacttatttttttattatgcttcagttaatacatatccataagcacgtgtacgtccatcaggatctttttgtagatatacgccctgaatttccggtgcgaatccaggaagaacattaatgccttcttccagtgcaaggaaatattgttgtactgtcgtactccaacgttcaccgggaacaacacataaaacacctggagggtaaggtaatgcaccttcggcggcgattctccccacaatatctgtcaatggaactaattcaattttgttacgaacaaattcgatattcgctttttgtgggttcatagcatattccggtagagttgtttttctaaacaagtcacgttgtagctgtttaacatttctactgacgtaaagattgtgcatttcttgacataattgtctgatagtgtagccctgatagcgttcctcattatttttgtacacagtaggcagtacatctttgagtaatgaattttgtttgatatgtttttcaaacgcagctatttgagcaactaaagtttgcatttttgtcaatgtttcagccggtgtaagcaagaataaaatggagttcaagtcacatttttcaggaatgattccattttctcgcaagaagttagcaaggattgttgctggaataccaaagtcttcatattcccctgtttcaatgttaatccccggagttgtgagcatgaatttacaagggtcaacaaaatattgattatctgtataaccctcaaatttatgccatgtatcatttgcatggaaattgaaaaactcaagatcatttgcaatttctttagtatcgtgatcttgccattttttacctttcacataaggaggaataaatggtttgattaaagtgcagtgcttaagcattaactttcttgcctcgataccaacttctacacactcggcccatagacgtttccctgcaggagaaccttgaatttgagcgtttacatccagagtggcgaatagaggatagaatgggctggtagacgcatgcaacataaaggcattattaaagcgtttgtgattgcaatatcttgcttgtcctttaatatgtttgtcttttttatgaatttgtgatgtttgtgagaaacctgcttgttgtttatgtaccgattgtgtcacgataataccagggtcattttcatttaaatctagtaataatggagagcaatctttcatcattggaatgaattgttcatagccgacccatgcagaatcgaacaagatgtaatcgcataaatgtccaatacgttcaacaacctgtttggcattataaattgttccgtcataagtacccaattgaataattgcaagacggaaaggacgtttctcttcaagtttttccggtgccacttctgcgattaattttttaagatatgcttcttcaaaacagtggttatcaataccgccgatgaagccgaatggattacgggcagtttccaagtaaacaggggttgcaccagcttgaattaaagcaccgtggtgatttgatttgtgattgttgcgatcaaataatactagatcacccggtgcaagtagtgcgttacaaaccactttattggaggcggaagttccgtttagtacaaaatatgttttatctgcattatatacttttgccgcatgttgttgagcatcacatggagcaccctcatgtattagtaaatctcccaatttcacatcagcattacaaatatctgaacggaaaatattttctccatagaaatcgtatagataacggccggctggatgtttgcggaaatattgaccgccttggtgtcccggacaatcaaatgccaaattacccatttcgacatattcgcttaacattttaaagaatggaggtaacattttttgctcataaagagacgcagctgtttcaatttgacggctatacaaattgatatcatagctgtttagatcttgaacatgataaacctgatcaaaatattcatcagaaagtgtttcaccttcatttaatacgacaaaaataggaatattaaattcagtcgtttttatttgttgaatatacttaacatcttcggcagtcaatattattgcacctatatcggtgaaatcagtttgatttaataaaactaattcacgagttgatgtaaaatatttttgcactaatgggctatgtgcgatttttaattttaacataaaagactcctttgtcttatttaaagaatacaaatcaccctctcacaataaatatagaaatagtgagatagcttacttttaaagttttataaattattaatataaacagtacgtgaatttttatatttatttaactataaaaaacacgaacacttattctagaattaagaacaaacacaggtttttatttatcaagaaaaaccgtataaagaatataaaaattctaggacaaaatattaataaagtagaaaaccgtgaaatcccctttatttaaagggaattaaatggaaaagaattgatatggattacttttagaatggagaatagcaaaagaaaaacaagaacgatgggacggtttcataaggtgtcgagtacgacgaatatgtgccatcaaagagcgacccttaatagggttatattcttgactataattgtggtctaacataatagcctccgaaatttattttgcttatatagttttagttgactatcgaagcaaattttccgcctataaaataaaaagtcaataaattttattttttttttttttttttttttttttttgatggagatcacaaaaattaaatttttttactattttatgttatgaattattttccttttttgatccaatatttaaatggagtgttttctaaatcactttttaataaattatgatccataaattgacaaaagctaggaatatctctagttgtggcaggatcatctgcaagaattaataatatttctccttcttgcatatggcgaatttttttgcgtaagagcattattggttccggacaacgtaatccaattgtgtttagagtttgtgttacaataatatcagtcataataatttctttgttagaatagaaagcgtgtatgatagcgtccaatttctttagggtcaaaataagcaaagtatgaaatatcttattccccaaagtgcggttgtttttgaagaagaaattaagaagagccgttttattacttatcttcagcatgcagaaggtttggagcaggctaaagcattttggcattcaataaaaaatcaacatccaaatgctcgtcatcattgttgggcaacggtttcgttacaaccaggtaattcgcaaggattagggttttctgacgatggtgaacctagcggtacggcaggaaaacctatgttgaatgttttattgggaagtggtattggtgaaatttctgctgtagttgttcgttactatgggggaattttgcttggtacagggggattagtgcgagcttatggaaatggtgtgcaacaagctttgcaattgttacagacaagtttaaaaatagaacgaaaaatttatcaactttattgtgcgtatcatcaggtcaattggttacatattttatttgaaaaatataatattaggatcatttctcaacattttttacaggatgttcaatttgagttgggtataagtgatgataaactggcagcatttcagaatgacttatctagttattcagcaggacagttaagattattagaaaacaaataagagagaaaattgtgcatattttatctattctgcgtatagtgggaattctagtaacctgcttttccattacaatgttaattccggcttttatagcgttgatttatggagatgggggtggaaaggcttttatcttgtcgtttttttacaatctttcagccggagttggtttatggtggctatgtcgagcacataaggcaagtttacgttcacgtgaaggatttttaatcgtcacaatgttttgggttttgctcagtttattggcagttattccttttatgttgttcgatgagctaacattgagccttgctgatgctgtatttgagtctttttcagccttaactacaacaggggctacagtaattttggggttggatcatttgccaaaatccatccttttttatcgtcaacttttgcaatggattggcggaatgggattgattgtattagtggttgcgattattccattgcttggtattggtagtggtcatttatatcgagcggaatcttcggggccaatgaaagatcaaaaagccttgcctcgtatcggtgaagtggcaaaattattatggtttctctattgtatattgactattttctgtgcgttttcttattgggctgcgggaatgagttggtttgatgcgatttctcatagtttttctacggtgtcaaatggcggaatgtccaattacgacgccagtttaggttactttgataatccggctatttatttgattagtgctggttttatgctgattagtggttgtaattttgctttgcatattcgagcattaactaattggaaataccaacctgtctggaaaatttacgcaagagatcctgaatttaggtttttctgtgcaattcaagggatatttattttcttattatcgttagggttatatttgacctatgaaaattattctgtttttgatgctttctcacaaggtgcgttgcagtcagtatcaatggcaatgacttcaggttatactttatttgatttaaatcagcttccggcttttttggggatgttactggtctttatggcaatattaggaggatgtgcgggatctactacaggtggtttaaaaatgattagagtgcttgttgtatggttacaaatcaaaagagaatttaaacatttagttcaccctcatttggttattccaattaaattggggaaaatgttattggcacagagagttattgatgggatatggggatttttaattgcatttttcttaacctattgggtatgtgtatttgcggttatattatgtggaatgaatgctgctgatgcgatgttgtctgtctttgccacactaacaaatgttgggccaggtttgggaataattagccaaagtttttcacaagttccggataatgctaaatatgtattttcttttgctatggcagccggtcgtttagaaattttttctcttttacttttgtttacgccgactttttggaaatcataatgaaaacattgattttatatttaagccgagagggtcagactaaaaaaatcgcagaatatataggcacaaaatttgaaaaaagtgcggtacaatctttgcttgatttttctggtgatttagctaccttcgatcgtattattattggtgcctcggttcgctatggtcattttgatcaaaaactttatcaatttttgcaaaaaaataccgcacttttacagcagaaagagagcagtttttttggtgtgaatttgacagctcgtaaagaaaataagaatacaccggaaacgaatgtttatattaggaagtttttacaatgtattcggtggaaacccaaatatgtaggggtgtttgccggagcgttgttttatcctcgttattcttggtttgatcggatgatgattagattaataatgaaaataacagggggtgaaaccgatgtaagtaaagaaattgaatatacagattgggaaaaagtagacgattttgtactaaaaattagacaaggtgaatgaaaaatcagcttttgattatatatttgaatttttttgcaaagattgcttgcaaggaagtgataattttctataatacgcctcctcctcttttagaggggaatgagaaatgaatatcatagattatttggaaaaattttaagtaatcacttgacatgaggtttcaatctcactaaaattcgaagccttgcatttttgatgcagtgtaaattgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgacagtagttttcgttgaaatagagttgattttgataatattacttacttcataccccgacaaaaagtcggggtattacgttttaaatcagcaaagttgctgcttttatgacagcttcaatagctttctgttcagtttgatgaatggtttgttcgtttggaatttcttgttgagtacggtttacgattacacctgataccatacctgcacgcagtcccaaagctgaacacattgtaaataatgttgcactttccatttcatagttcatgacattcaatgcttgccattgttttaatgaaccttgataatggcgacaaacttttccgctataggtatcgtaacgttcttgtcctggatagaaggtgtctgatgaggcggtaatgccgatatgaacactatctccaggttcatttgaaacagcatgatgtaaagcggacatgcaatcaaaatgggcaacagcaggatattctagtggagcaaaatgacggcttgcaccatcaagacgtactgctcctgtggtaataagaatatctcctacgttgatgtgcggttgaattgcacccgttgtaccgattctgaggaaagttcggattcccagttgtgctaattcttctaccgcaatagaaacggaaggaccaccaattccagttgagcaaacaacgacggctttttgacctatataacccaaccaagaagtaaattctcgagttgaagctaaaaatttcggattatccaatagacgagcaatacgttctaccctttcaggtgcacctggtacgatggctaactctgctccatccaataaggcttttgttaagccaagatgaaatacatcagacataaaatattccttttgtttattgtaatatctctcagtataaagcacctctgcaatttcatcaattctttcctgttggtataaaatatgggaagatacaatatgagtgttaaggttggactctaatcttctataagattagaatattccttgaaatataattccacctgttggtagaaaaattgattttttcactgctctttttattagtatttatttttaaaatatcggtaaatgagtatatcatagagtatgtttttatatatttttcatattattttggactatggatataaaattacatttaaatgcaactacgaccccaaaaattcgagcttatttacaaaaatcagataaatcagatcttgagttagcagaacagttaggcatttcggttcaaacggtacgtcgttggagaaataggcaagatgttaatgatcgttctcatagaccgaaaaaaattaatagaactctttcttttgaacaggaatatttgatttgctacctacgaaaatatttcgctttatctttagatgaacttcttgaagctggaagaaatctaatcaatcaaagagtatctcgagcagttattagtcgttgtttaaaaaaatatggtctaaatattgctaataagaaagatttaccatctcaagttggttgtacttttttggcaatgtttcccctgcctaaagagatttctaaagaggaagattatctttttattctaatagagaaattgacaggatatatcagttgtgcttgcttggacagaaaactacagcgtcaacaaagtattatcaattactttaaatctagtttaccttatgaaattcaagagattgagttagccgaagatattactcatcatgccatagtacaggcttttgccaaaaagactaaagtagttacgtctaccttaattttgcaaagtgcggtgaattttgaacaagattttatacggttagtatcaggttattacactgatagcagattaggatttgatgcacaactattaagatatgaagagtatctgaataagcatcttaaacgaaatcgcttaaaaaaactgtccccttatgattatcttatgaaatatcgccggtaggacagttagtttttttatttttttcgatatagctcaataaattctttgatgatgtccattaacaaaacagcattcattacatgatcttgtgcatgcaccataataatagtgacgggtagtttcccctcaccttcatcctgtccgatgagttctgtttgagcgtgatgtgctgctaacaaagcatcatccgcctgtttaagtaatctatctacttcctcaaactgctgttttttagcatgttgtagtgcttccattaaagcactacgacatattcccgcttgaagaattaaattcatcaattgcatttcaagttgctcactcatttttcctccaataaagatagtgcttgtgctaaaattttttctccatcggtcatgccataactcatcatatcaatacaagcgacaggtttgccgaattctgcaccaatagtttggcattcttgcagcttataggaaatttgaggacctaataggacacagtcaaaatcttgtattaatgaatgaaagctttgcatacccttagcttcaatttcaacgggtaaaccctgtgcttcagctgcttgtttcatacgtttaactactaagctggtggacatgcctaaatcacaaataagtaaaattcttttcattttttctccctattttgaaacattatttttcagaaattgataaagtagatgtaatggtttaccgcttgaatagattccttgatctctaaataaggttgtgccgctaatatctaaatgagcccaagtgcagtcattaacaaaccgactaaggaaatatcctgcggaaacacaaatcgccgcattatttggcggagtgttgcaataatctgcaatatggctttccacttggccgagaaatctatcatcacaaggtagttgccatatcgcctcttgtgtttgtattgcggctaaattaagttgatgtagaatttctgtattatttgtcatcacaccggaaatatcataaccaagtgcttttacaacagctcctgttaaagttgcaacatcaataattactgagggtttttgttcagctgcgaatgataataaatcagctaaaattaaccgcccttctgcgtctgtattaataatttcaatagtttttcctgaataagatcggacaatctctccggggcgcatcgctttttcatttatcatattttctgctacaccgacaataatacgtatgttaataggcaatgaattttctacaacggtttcaagtaagccaattaataaggcagcaccacacatatcatatttcatggttttcataccatcgcctgtttttaaccataatcctcctgtatcaaaagtgatacctttaccaacgaaacaataggtctgattacaatcaggggagccttggtaatcgacttgaattaaaaaagggggatgtaaaccgcttttacctacggcatataaagtgttcaaaccatggttttgtagctcttctgcatctaagcttcgtatggaaagttgagatttatgtgcataactgtttaatttttttgcaatatattcaggcgtcgcaatatcgctaggcagatctgaaatttttctggctgttatcatacccaatactattttgcatagttctaaataattattcgatagttgccgcttttgctccggtgtttccactataacaccaaattcaggcgatgcggcggtctctttaaaacctaaatattttggatggtaagaaaggttgagataactaataatcaattgttcattgatctgccgttctaattttacggtttcttttccccaatgtaataagattctttgtgcatctgagtgtgccattttttccatcaaaaaatgacgtattttccccattaagtgtgggttttcagccacttcttttttagaaaaaggtaagctatataagccggcattcgatatatttctgcctatctcgattttgctttccatgtccagtatagaaagcagaggtttcaagcagggttgttgctgtaaaaaatctcgatcttctttccaaaaaaacaacaaagcgttttttatctctaattgggtttgccaatcataaagcggaaattcaatgttcattttaactctccatgaatgcggtcaagataagcttgtagccaactttctgaggccggttcatattgtgtaattccattttctcgtttagccagataaatgatagggttatattgctctgttgatacgacaaaggaaaaattatcaatattagttgatacaccgaactctccttgcatattcatacatacaaccgacaaatctcctgctgttccgtaacgttctaataatcgtatttctaattcattgattgtcgcatcagcagcttgttgtggtgtcatcccctctttcatttttcgtacaatttcataactggtacagcctttcattaagtcttcccccagacctgtagctgttgccgcacctatatgggaatcagcatagaatcctgaacctgagataggcgaatctccaactcgcccatgacgtttcataaataacccactggtagaggtacccacacaaatattattatttttatcaagtgcaataatgcccaccgtatcatgcccggaatatggacttaatccacgaccgagagtttcttgatagcgtttttcataaaatgttttaacacggggtgttagcatatctttagcaggaaagcctttctttaatgcccatttttcagcaccgtgacctaccaaaaaactattaaaacgttcatgacttaatgcttcggcaacgagaattggatttgcgatattacgcaagccggctacagctcccaatgccagagaagttccatccataaaggcagcgtccaattcgacatctccctcttcattgggtaacccgccataaccaacagatttatatagagggtaattttctacttgtgtaaccgcagttaaaattgcatctcttgcacttcctttgtttttaagtaattcaactgcctgacaaagtccttcaaatgccatacgccaagttgcaatcatcccccatcttgaattattcatttatacttgtccttctttcattcgatattgcttatcaataatacggaagaatggtaaataaatcattgcagcaatgaataagttgattacttgtataagtgcgccggaaatatgcccagttacaataaaaccacttaaaacaggcggtaatgtccaagggatataaactccggttgtcgtcgcaacaatatccaaatacattgcaacatactgtactgtagtaataactaaaggtgcaagattgaatgggataagcataattggatttaaaataacgggcagaccaaataagacaggttcgttgatgttaaataccgatgagccggcagctaaacgtgacacttttttagcatgttggctacgggcaaaaataagcattgctaagactaaggcgagagttgaacctgaacctcccataaagatcatatcaaagaattgttcggtaatcacatgaggaggggttaatccattttgcattgctgccaggttttcagcttgattatctaaccagaacggtcgtaagattccattaaccattgaacctgaattgattcctaccgaccataaaatatcgatcatgaatacggtcagtaatgcaccaatataagaagtaccaaaatggcgaattggtgtagccagcacggtatatacaaattcatgaatagtattatattcagttttcgagaataaaatccgaatgcctaatactaaaatcataatcaataaagccggtatgagagctgagaatgactgttgtactgccggcggtacgccgtcaggcattttgatcacaatatttttgcgaatgagaaaggcgaataattcggtccaaatgattgccccaagcatagcaataaataacccttttgatcctaaccattgtgttgaaataactgaaccgacgttttcaactttaacaaaaggagtcaaaataaggaaagctgagagagataatataccggaggaaagtttatctatatttagacgttcagcgagtctataggcaaccagaaaagcaataaatatagacattgtagaaaaaacagcattaaagggaatttctatgatattatcccaaccctttccaaaggttgcggtcatgaaatctttatagctttgagatggaaatgaactaattaccagtaaaatagaaccaacaatgataaaaggcataaacgaaatataagcatctcgaattgctcctaaatgacgctgttgggctaatttaccggcagccgccatcaatttattttcaatttgtttaagcaaggacataataacctccagtaagtaagaaattacaaaacttattgtaggtgatttttgtttgaaaaaagttgataaagatcacaaaattaaaaaagtatcatatgattaattttattttaatgtacatattattagaatatatttaattttttaaatgtttaatgatgtgatacattttttgaggtttgtatggatatagaaatatgtattgataatattgagtcagcattaattgcacaaaattcaggtgcggctcgtttagaagtatgtggatgtttagcgttaggaggggtaactcctccttatagcctgatcaaaacagtattggatgtgtgtaacattccctgttatgtaatgattcgtcccagatccggagattttttatttaatgcacatgaaataaaaatgatggagcaggacatccacattgcgaaacagttaggagctcaaggtgttgttattggagcattaactgaaaatggtgaaattgatttatcaatttgccatcgtctaataagtgcggctgaaggtctgggtgttacttttcatcgtgcttttgatctttgtaccgatccttatcatggtttagaacagcttgttgaattagggtgtgagcgagttttaacttcaggacagcaaaggacggcatttgaggggagatatgttttaaagaccttggtacaacaggcaaaaggacgaattaagattatggcaggtgccggcgttaatccaaataatgccttagacttggtaaaaaccagtaaagttgatgaattacatttatcagccaaaacttttcgtcagagttcaatgaaaggtaattccagtgtgacgatgggaaataaagcagaagatgattacaaaatttggacaacagatcgaaatcaaattattgccataaagaaacttttctaagaatagaggggcataaattttatctggagagcggtgaaaaaaacaaaattttcaccgctcttttttcattattcaaccaactaattttgccgtgaaaatattactaataaccacaacatttttagagaaataaggtagaatacgcccctatttatttttataaagagctttgttttatttatgttatttgcaattggtcagcgttggataagtgaaagtgagaatagtcttggtttgggtattattacgggacaagataatcgtaccgttaccatttcttttcccgcctcggatgaaatgcgtatttatgctttagcaagtgcccctttaactcgagtattgtttcaaaaaggtgatgagattacacaccaattaggttggaaagcaaaagttgttgatgtcatgattcgcaatgagttggctttttatcttgtgcaacgacttgataataacgaagagattgctgtacaagaaatggaattagctcaccaaatttcttttagtaaaccgcaggatcgcttatttagtacacaaattgaccgcaatgagcattttgtattgcgttacaaggcactaaaacaccaacaagaacaatttcagtcctctttaagaggattaagaggaaatcgagccggtctgattcctcatcaattacatattgcacaagaggtagggcgacgtatcgcaccgagagtattattagccgatgaagttggtttggggaaaacgattgaagcgggtatgattttacagcaacaattgcttgctgaaaaagttcagcgagtgctaattttggtgcctgaaaatttacagcatcagtggcttgttgaaatgctacgtcgttttaacttgcatttctctttatttgatgaagaacggtgtgctgattttgataatccggaagatcatgttgaagcaaatccttttgttgctgaaaacctaattatttgtgctttagattggcttgttcaacaaccgaaacgtgcaaaacaagccttggcgggtgagtttgatttattgattgttgatgaggctcatcatctcacttggtcggaagattcgccaagcatagcttatgaattggttatgcaattaagtgcggtgattcctgccgtattattattaacggcgacaccggagcaattggggcaacaaagtcattttgcccgtttgcatttattggatcctaatcgtttttatagttatcgggcttttgaaaaagaacagcaacaatatcaacctgttgctaaagcagtacaaagtctgttatcagagcatattttaacagttgaagaacaaaatcatttagcagaattacttagcgagcaagatatcgagccaatgctcaaagtgattaattctcaagctgatacggaacaaaaacaggttgctcgaggagaattaatgagtaatctaattgatcgtcatggaaccggtcgcttgttatttcgcaatacaagacaaggtgtgcaagggtttcctcatcgtatttatcatcaaatcaaattagatttaccaacacaatatcaaaatgcgattaatgtgttgaagatgttgggggaaataaaagatccagagttattttatcctgagcaaattttccaaaaaatgaatgcggatgcaacttggtggcgttttgatcctagagtggattggttaattaatttagttaagagtttacgtgaagaaaaaatcttagtgatttgtcaagatgcgataacagccatacaattggagcaggcattgcgagagaaggaaggaattcgtagtgcggtatttcatgagaatatgtcgattattgaacgagatcgtgcctctgcatattttgcacagcaagaagagggtgcacaggtattactaagttcttcaatcggttcggaaggtcgaaattttcagtttgcttgtcatttagtgttattccatttgccgaataatcccgatttattggaacaatgtattgggcggttagatcgtataggtcaacgtcgagatattcaaatttatgtcccttgttttgctgatacaccgcaaattcgcttggctcaatggtaccatgaaggtttgaacgcatttgaggaaacctgtccaatgggggctattttgcatgaaaagtgcggtgcaaaattgacagaatttttaacttcagacacaacggacgattttcaggcttttattcaacagactcatcagcaacaattacagctaaaatccgagttggagcaaggtcgagatcgtttattggaacttaattccaatggcggtgagcaggctcaacaattagcgaatgatattgcgatacaagacggttcaacagagctcattgatttcacattgaacttattcgatattattggtgttgagcaagaagatcttggcgaaaaatctattgtcattagcccgacaggaacgatgcttgtccctgattttccgggtttaaaagaagaaggggttactgttacttttgatcgtgatttagcgttggctcgtgaagatcttgagtttcttacttgggatcacccaattgtgcgtaatgggattgatttaatcgtcagtggtgatataggtaaaagtgcggtggctttattggtaaataaacaattaccgaccggtacattgctacttgaattagtttatataattgagagccaatcaccacgtggattacagttgactcgctttttacctccaacaccgctacgtttacttcttgatattaaagggaatgatttaagtcatcaaatttcttttcagggcttgcaaaaacaactgaaaccaatgggtaaaaatatggcaacaaaagtcattaaaataatgcgtccagcgattgagcaattaattaagcaaagtgcaaaaaatgtagttgagccagctaaaatgataattgaacaagctaaacaactggcggatcaatcattgagtgcggaaataaatcgattatatgcgttgcaggcggtcaataaaaatattcgtccggaggaaattgaacagttagaaagtcagcgtacgttatctcttgaattgcttaatcaagcaaattggcgtttagacagtttacgggtaattgtgagtaataaggaataacatggcattaattgattatcgtccccctttagaaccttatttggacattgtatatcgtgatgatcatattctcgtggtgaataaaccgagcggcttgctttctgtatccggtaatcaaccgcaatattatgatagtgcaatgtcgagggtgaaagaaaaatatgggttttgtgagccggcacatcgtctagatatggcaacaagcggcattttgctttttgcaatgagtaaaatggcagatcgagagctaaaacgccaatttcgtgagcgtgaacctaaaaagcattatcaagcactcatttggggacatttgacgcaaaataccggcacggtgaatttgccgttgatttgtgattgggagaatcgcccaagacaaaaagtgtgttttgttcatggcaaaagagcggtaacaaattttaaagttttgcatcggtttgaaaataatatcactcaagtcagattaacgcctattaccggaagatcccatcaactgcgtttacatatgcttgcattaggacacccaattttaggggataaattctatgcacatccacaggcaaaatcgcttgcaccacgtttgtgcttacatgcagaatttttacaaataactcatccgcgtacaaagaaagtgattcagtttagcacaccggcggattttccgatttgagttgctagcataaataatcagcccttaatctatatgattacgggctgtgtgtttataaggaactattgtctatttttataatactcaatagcttgtggcattaattttaataaattcgcttggcgagcatcatcggtggggtgagttgagatgagcttatccagcaaaccttttgaacccacggaggcttttttcattttttcccacaattgtggtgctgctttaggattgtagcctgattttgccatcaggaataagcctacttcatccgcctcttcttcggcactacgtgaataaggtttatttaagccccaatccgcagcaagtccgacaatcagtccacttgcgtcagtgccaaattttgttgataaagcaacatgagcaacttgtgcaactacattagtgaacgtacccaaattcgcttttttcttaccatgttcttttaacgcatgtgccatttcatgccccattactgtagcaatttcatcatcagttaattttaagttgtcaactaaccccgtataaaacaccattttgcctcccggcatcgcccaagcattcatttcttttgatttgataacatttaattgccatgtaaaaacttgcccggtgttgttttctttatctgcataagggcgcatttttttaaaaattttatgtatacgttttgccgtcggtgagcttttatcaaccactccttttgcttcagcttgcccgattatctgcacataacttgaggcagactgttgattaatcgaagatgaatctgcacaagcattgagcagtaacacagtaaatatgacaaaaataatttttttaatcgacataatgatatttaaactgttaataaaaaaccgctctttgagtaagagcggtttttagagattattttttagcacgttcgaatgattctaaaatttcttggcgagctgattcaacaccttcccaaccgtcaactttaacccatttacctgcttccaatgctttatagctttcaaagaagtgctggatttgtgcttttaataaagccggtagatcatcaacatctttaatataatcatattctttacttaattttgtgtgcggaacagctacaactttcgcatctccaccagcttcatctgtcatttttaatacaccaactggacgacaacggattacagaacccggttgtaacggatatggcgttggtactaatacatccacaggatcaccatcagaagaaagtgtattatttacataaccatagttcgccggatagaacatagcggtcgccataaaacgatcgacaaataatgccccactttctttatctacttcgtacttgattggatctgagtttgccggaatttcaatgacaacataaatatcatccggtaacgctttaccggcaggtacattttctaaacccatttttcttttccttttacatgttattgatgaatcagattgcggaattatagcgttatttctagggaattgtcgagttatcaacaaagaatcttcttactgaaaaaagtattgtaaaaaagttttgaactattataatagtgcaaaattcaattttcaaaatgaggatctattatgacaaaaaaaatcccttctttatttggtggtgcaatgattattgccggaggaactatcggtgcaggaatgttagccaatcctacttcaactgcgggtgtatggtttttaggttcaacattaatcttaatttatacttggttttgtatgacaacatcagggttgatgttacttgaggcaaatctacattatcctactggtgccagttttgatactattgtcaaagatttattagggaaaggttggaatttgattaatggtgtgtccgtcgcgtttgtactttatattttaacctatgcttatatcacttcaggcggtgggattacgcaaggtttttttaatcaattgttaagtagtacagaaagtgcggtagatattgggcgtagttccggatcgcttatcttttgtattgtgctggcagggtttgtatggttttccattaaagctgttgatcgtttcagtgtggtattaattgcaggaatggtcatttcctttttcctctctataaccaatcttgtcggctcggtgaatacagaaatattgttaaataccgtacaaggtgaacaacaatatttactttatgcgttagccgcattacctgtttgtttggtttcttttggctttcatcaaaatgtaccgagcttagtgaaatattatgatcgcaatgcaagtcaggtcttaaaagcgattttcatcggtacaagcattgcattagtgatctatatcttatggcagttggctattcagggaaatttaccaagagctgaatttataccagtcattgaaaagggcggtgatatttcagcattattagacgcattaagtaaatacttacaaacggattatatagcacttacactgaaattttttgcttatatggcaattgcaagttcattcttaggtgtaacgttagggttatttgattatatcgctgatttatttaaatttgatgatagtgttgctggacgcactaaaacagcgttaattacgtttttaccgccattattattgagcttacaatttccttacggctttgtattagccattggttatgctggtttagcagcaacaatctgggcggtaattgtaccggctttattagcgaaagccagtcgtaagaaattcaaaagtagcagttttaccgcttacggtggaaattttatgatatatttcgtcatcgcatttggtttattaaatatcttcgcacaacttgcaatgcagttcggttttttaccggagtttagaggctaaatagcttgaaaaagtaagaaaaataattatcttgttaacgtatgctttatttggcacccactgtagatacgtgggtgcttttctgtaaattttcctagtattagctttgatttgtttgctatagtaggcacaatttttagggagtattgtaggataaaaatggcagaaaaaatcattattgctgaacatcagtttatgcgtacgatttctcgtatttcccatgagattatcgaaaaacatcagtcgcttgatgatattgtgattgttggcattaaacgtcgaggtgctgaacttgccgagttaataaagcgaaaaattatagagttcagtggaattgaattgccctctattgatttagatatcactttttaccgtgatgatttagagtatgtggatcaacagcaccaattgcctgtttatagtggagcatccaattatattaatatccagaataaaacagtgattttagttgatgatgtgttgtttactggtcgtaccattcgagccgcacttgatgctttagttgattttggtcgagcggctaaagtggaattagtgatttttgtcgatcgtgggcatagagaattaccaattcgtgccgattacgtcgggaaaaatattcccacaagtcgtagtgagcaagttcaggttcgcacaatgcaatttgatgatcgttatgaagttgccttggtcacaaaataacatttgtgaaccttttgcaaaattgctactctaatgaacaaatttacaaacgtcttacggaatgaaaaagcggaataaaaaaatgaaagtatttaatttcaaagcagtgttgttttcaataattggtctacttagcattacgataacagcacaggcggctgaaagggtagtggctaccgttgatgggaatcctattttagaaagccaagtaaaaaaggtgttgggaaaacgagcaaataatgaggaaaatcgtcaaatagctttgaatagtattattgatgatttactagtacaaaaagctattcaagagttaggaatcaaggttgctccagcacatgtagacagtgttatcgaaaatattgctgcacaaaatggattaacctttggacagtttcttgatgtcttagattatcagggcattaattatcaggcgtatcgtcaacagattgcctatcagattttaatatctgaagtgcgtaatcaagccattggcagtagcgtgaatgttacccgtgaagaaattcaagacttaggactaaaactatttaaacaagcgaaaaaacaaggaaaagagaaaaaagtaaccgcacctgaatataatgtacggcatattttgttaaaattgaatcctctgctgaatgatgcacaagccaaagcaaaattaactcaaattcgtgcagatattttggcgaataagataacctttgcggatgccgccttgaaatattctaaagattatctttccggtgcagatggtggaagtttaggttttatgttccctgaagcctatgttccagagtttgccaaggttatccgaacatctaaaaaaggtgtgatttcgacaccatttaaaacagagtttggttggcatattttagaagtaacggatattcgcaatgcggatataacgagagaagcttatatgcaagaagcatatcaacaaattgtgaatcaacaattgcaagaggcatcaggcgactggataaaggctttgcgtaaacgagcacatattcaatattttaattaattatgagatcccgacgcaaagtcgggatttttgttttataataccgccaattttttagcattcacactttcacttatgaagtcaaaaacacatttaggacatactgctcgtaaacgttttgggcaaaatttcttgcatgataataatattattcaaaatattgtgatggcaatttatccacaaaaagaacaatttcttgttgagattggtcccggtttaggtgcgttgactgaaccggttgccgaaaaagtagagcgtttaacggttattgagttggatcgtgatcttgctgaacgtttacgccatcatccatttttacatcaaaaattaaatgtgattgaatatgatgcaatgcaatttaattttgaacagctttatattgatgaaaacttggctgagaaaaatcagaagttacgtgtatttggtaacttaccttacaatatttcaacacctttgatgtttcatcttttcaaatatcatgcaattattcaagatatgcactttatgctacaaaaagaggtcgttaaacgtctttgtgcagcaccaaacagtaaagcttatggtcgtttaactatcatggcacaatatttttgccaagtattaccggttttagaagttcctccgaccgcatttaaacctgcacctaaagtcgaatcggctgttgtgcgtttaataccacataaagaattaccttatccggtgaaagatttgtactggttaaatcgtgtgactacacaagcctttaatcagcgtcgtaaaactttacgtaatgctttatcaaccttattttcggcggaaaaattaaccgcacttgcaattgatttagaggcacgagccgaaaatttatctattgctgattatgcaagattggcaaattatttagcggataatccgccaacagaagatctgcaatcggagtaaaaatccaagacaaaactgcaagagttaagataatagtcaatgacaacattatggcaacttatttagtcggtgatttacaaggctgttatgacgaattacagcttttgttagagacggttcaatttaatcctgtacaagataaactttatcttgttggtgacttagtagcacgaggcgataaatccttagaatgtttgcgttttgtaaaatctttaggggcggcggcacaaatggtattgggcaatcacgatttgcatctgatttcaaccgcacttggtattaaaaaagtaagtttacaagaccatgtcgaagcgatttttacagcaccggattttgttgaattaattgattggttgcgacatcagcctttacttgttcatgatgaaaaatgtgattttgtcatgagtcatgcgggcatttcgcctgactgggatttggataccgcaaaatcttgtgcaagagaagttgaaaatgaattacaacatggtgattaccattatttaatcagcaatatgtatgataaccaacctgatcgttggtctgccgatctgcaaggtttgcaacgtttacgttatagtatcaatgtatttactcgaatgcgtttttgctacagggatcatcgcttagatttcgcttgtaaagcgtcagtagaaaaagcaccgcaagaacttatcccttggtttaacttggataatccgttgtttaaagtacaaaatttggttttcggacattgggcaagtttagtggatacacctacaccggcaaatatttatgctcttgatacaggttgtgtttggggtaatcgtatgacgatgttgcgttgggaagataaacagtattttgtgcaaagagcggtgaaagattatttttgaaatggtaactgtgcaatatnnnnnnnnnnnnnnnnnnnnnnnnnnnnnnnnnnnnnnnnnnnnnnnnnnnnnnnnnnnnnnnnnnnnnnagtatgcggttgtattgtatgcaacgatttttccttgttgccacttaagaatttccctgttaatttctccggttttaagctatcctataccacattttctatatctaatttgaaccgcactttccattattaataagtcttttagtcaggtttttagcggaaaaagagcggtaatttttcatataaaaggtaatattatgcaagaacaatatcgtcctgatcttatcgaagcacaagtgcaaaaatattgggctgaaaataaaacattcaaagccgtcaaagatccttccaaagaaaaatattattgtctttccatgtttccttatccttctggtcgtttacacatggggcatgttcgtaactataccattggcgatgttatctcccgttatcaacgaatgaacggtaaaaatgttttacagcctatgggctgggatgcttttggattgccggcagaaggtgcggcaattaaaaataaaacggcaccggcaaaatggacttatgaaaatatcgaatacatgaaaaatcagcttaaagtgttgggcttcggatttgactgggatcgtgaaattaccacttgtaaacctgaatattataaatgggagcaatggttttttactgagttgtacaaaaaaggattggtttataaaaaaacctcaacagtaaactggtgtccgaatgatgaaaccgttttggcaaatgagcaagtacatgaggggtgttgttggcgttgcgatacccctgtggagcaaaaagaaattccgcaatggtttattaaaattacggactatgctgaacaattattaagtgatttagatcagcttcctgaatggccggatatggtaaaaactatgcaacgtaactggataggtcgctccgaaggggttgaaattacctttaacgttgatcattcagatcaaaccttaacagtttatacaactcgtccggacactttctacggcgtttcttatttagcggttgcagcggcacatccgttagctgaaagtgcggcaaaaaataatcctgaattggcggcttttattcaagagtcaaaaaataccaaagtggcagaagctgaacttgccacaatggagaaaaaaggtatggcaacaggattgtatgccgttcatccgattacaggcaaacagttaccgatttgggtagcaaactttgtgttaatgcactatggtacaggtgcggtcatggcagtgcctgcacatgatcaacgtgattatgaatttgcccaaaaatatcaattaccgttatttcccgtgattaaaccggcggataattctgaattggatctttcaaaacaggcttatactgagcagggtatcaccattaattctgccgaatttgacggtttggattttgaggcaacctttaacggtattgcggataaacttgaaaaaatcggtgtaggaaaacgccaagtaaattatcgtttacgtgactggggagtttcccgtcaacgttattggggagcaccaattccaatgctgacactggaaaatggtgatgttgtagttgccccattacaggacttaccaattgttttgccggaagatgtagtcatggacggagtaaaaagtccgattaaggcagatcctgaatgggcaaaaaccacttataacggacaagtagcattaaaagaaacggatacctttgatactttcatggaatcttcttggtactatgcacgctatacctctccacaatatcaacaagcgatgttagatgcagatgaagcgaattattggctaccggtggatcaatatattggtggcattgaacatgcaaccatgcacctattatatttccgtttctttcataaattgttgcgagatgccggtttcgtaacttctgatgagccaagcaaaaaattactgtgtcaaggtatggtacttgcagacgcattttattacaccagcccaaccaatgagcgtatttgggtatcgccgacaaaagtaacgttagagcgtgatgagaagggtcgtattatcaaagctgttgatgatgaaggtcacgagcttgttcacagtggtatgaccaaaatgtctaagtccaaaaataatggtattgatcctcaagaaatggtggagaaatacggtgcagatacagtccgtttatttatgatgtttgcttcaccggcagaaatgacactcgaatggcaagagtcaggagtagagggggcaaatcgtttcttacgccgcctatggaatttagtttttgaatacaatcaaaatccggcacaaaccgcattagatcctaccgctctttcagtcgagcaaaaagcattgcgtcgtgatgtacataaaactattgcaaaagtgagcgatgatattggtcgtcgccaaacattcaatactgcaattgcggcaatcatggaattaatgaataaactcaccaaagcatcattatccaatgagcaagatcgtgcagtaatggcagaagcattgaatgccgttgtacgtatgctttatccgattacaccacatatttgtttccaactttggcaagacttaggtaacgaaagtgcgattgattttgcaccttgggtgatagccgatgttgaagctatggttgaagatgaaaaattggttgtgatacaagtgaatggtaaagttcgtgctaaagtaaccgttcctgctgatatgtcggaagatgaaattaaacaagttgctttagcagaagaaaatgtacaaaaattcttgaatggtttaactgtagttaagaccatttatgtaccgggtaaattatttagctttgtagcaaaataagaaaacataaccgcacgtgaaagtgcggttcaatttaggggagtttttatgttcaaaaaaattaaaatagcattactgggtgttggcattttgcttattagtgcttgtggatttcattttcaaaatggtgaactaattccaaatgaattaagaacattggtactggaaagcaacgaccctcacagtaatatgtcaattgcactacgtcgtcaattacaagctaacaatgtgaatatcgttgataatcaaaataatgccactgttttgcgtctaaatagcacaaaaaatactgagcaggtagcctcagttttcaagcgaggttatgaagcagagaaaattttaaccttagaagtatgggcaacagtgagtttaccgaataaacaaagctatccgatttttgctaatgtcaaccgcactttctttgataactctcgtgccgcattagcaaaatcagcagagaaggagattatttggaatgatatgcgtgaacaggcagcccgccaattaattggcaaaatgattgcattacaaacgcaacttcaaggtaaataatgaaccgcatcttttccgaacagctccaattatcactcaataaacggttgtccactgtgtattatttggttggacaagatcctttattgctgactgagagcctagatgcaattgtacagactgcgatattccaagggtttgatgaaaagttagaaattactgtagatcataccactaactggcgttctattttggaacaggctcaatctatggggttattctttaagcgtcaaatgctgattttaactttacctgaaaatccgaccgcacttatacagcggaatttacaagaactgataacgttacttcataccgatatcttactgattttacagatggcgaaacttactaagccaatggaaaaacaaacgtggtttgaattagcaggacaaaaagagcctcaagctgtgttagtgaattgccaaacaccgactgtcgaccaattgcctcgttggatcagtcagcgtgcatacagtatgaaattagagattgtgccggaggcgataaatctgctttgttatagctatgagaacaatttacttgctttaaagcaggttttacaattgcttgatttgctttatccggatcataaattgacctttaatcgagtgaattcggtcatagagcaatcttccgtatttaccgtatttcaatggattgatacgttgttagagggaaaattagagcgggcagtgcgaattttacaagggttaaaagcagaagatgtacaaccgataattttgttacgtgctttacaacgagagctactcacgattttacaattgacccaaccacaacagcatatcgctaatattgacattccgctggtgaattcacaattaaaagaacggtttgatcgcttaaaagtatggcaaaatcgacgtcctttttttatccaagcgatacaacgtatgacttaccgaaagttgtatatgataattcagcaacttgctgatttagaaagaaaaaccaaggcggattttagtcatgatatttggaatgaattagataatttatctgcaaaaatttgctgtttttagttgaattcacaaagaatttaggtttattccatatctctactaacgatttttcttggattcatcattttttgtacaaaatatccgttataattcgtcaattaaaaaagttaatacataggaagaaaaatgatacgttttgaaaatgtgagtaaagcctatttgggcggtaatcctgctttgcaaggactcaattttcatttacctatagggagcatgacttacgttgtggggcattctggtgcagggaaaagtaccctattaaagttaattatgggcatggaacgagcaaatggcggtaaaatttggttcaatgggcataatattacacgtttatctaaatatgaaattccttttctacgccgtcaaattggcatggttcatcaggattatcgtttaatcacggagcataccattgctgaaaatgttgcacttcctttaattattagtggtattcatcctaaagaggctgaaactcgagcattggctgctttagatcgtgttggtttgcgtgagcgtgcgaaacattaccctgtttatttatcgggtggtgaacagcaacgagtggatattgctcgtgctattgtgcataaacctcaattattattagccgatgaaccgacgggaaatttagatatcaaattatcgttgggtatttttaatttatttgaagaacttaatcaattaggcatgacggtgttaattgctactcatgatttaacacttgtccagcagaaaccgaagccttgtttggttttggaaaatggttatttacgttaaggaaaggttatggctcatcgtcctatttatgcctcttggggcgtgcaggtacattatgtactgaaagcagtgttggcagggttaatcaagaaaaagtattcaactttaatgactattttagttattgcggtttcgttaaccattccaaccgttagctatttgttgtggaaaaatttatatcatgcaacgacaaaattttctcctaaaactgaattcacgctatttttgcataaaaatctatcggaaacagatgccaatattgttgtagagaaaatacgccagcaagagggcgtagaaagtttaaattatatttctcgaaaggaaagtttaaacgaatttcgtcatttttccggcttttctgaaggattggatattctggatgataacccgcttcctgctgttgtaatgattaaacttactcaagaatacaatgaaaatactaaacgccatcaactgcgtgaaaatctttttaagattaagggagtggatgatatacgtttagataatgaatggttagaaaaattgaccgcactttcttggctaatcgcacatattgcgatattttgtgccgtattgatggtatgttcagtatttttagtaattggaaatagtatccgatctgatgtatatagcagccaagcgaatattgaaattatgaaattactaggtgcaacagatcagtttattttacgtccttatctttacaccggcatgatttatgcaatattaggtgcgttatttgccagtatatttagtgccgcactcattggttattttacaagtgcggtcaactatgtcactgatatttttgcagtcagttttacgttgcaaggaattactatcattgagttattgtttttatttgtttgctgtacattaatgggctatttaagtgcttggctctcagcaagtcgttatatgaatttgttacataaaaatattagataaaaagcagaaaatttaaaattcttcgcttttttattaaaaaaacttgattttatcttaaatgttctgtaattaattgagatattctttttacaattcaacacaacattaactaataagggagattatatgaaaaatgtaggttttatcggttggcgtggtatggttggctctgtactcatggatcgcatggtacaagaaaatgactttacgaatattaatccagtattttttaccacttctcaggtaggacaaaaagcccctgtttttgcgggtaaagatgcaggtgaattaaaaaatgcgtttgatattgcagagttacaaaaactcgacattatcgttacttgtcaaggcggtgattataccaatgaagtttatccgaaattaaaagcaacaggttggaatggctattgggtcgatgcggcatcggctttacgcatgaaagatgatgcgattattgtgttagatcccgtgaaccaacatgtaattagtgaaggtttacaaaaagggattaaaacctttgttggtggaaattgtactgttagcttaatgttaatggcaattggtgggctatttgagcgtgatttagtggaatgggtttctgtagcaacttatcaagctgcttccggagcaggtgcaaagaatatgcacgagttattagtacaaatgggacagctggaagatagtgtcaaggacgaattggcaaatcctgccacatcaattcttgatattgaacgtaaagttaccgccaaaatgcgtgcagaggacttctcaacaaccaattttggtgctgcattagcaggcagcttaattccttggattgataaattattaccggaaacaggacaaactaaagaagaatggaaaggctatgcagaaaccaacaaaatcttaggactaagtaataatccaattccagttgacggtttatgtgtacgtatcggtgcattacgttgccacagtcaagctttcacgatcaaactgaaaaaagatttacctttagatgaaattgaacagattattgcaagtcacaatgaatgggtaaaagttatccctaatgataaagaagtaaccttgcgtgaattaacgccggcgaaagtaacaggcacattaagtattcctgtaggacgattacgcaaattagcaatgggacctgaatacttagcggcatttacagttggagatcaattattatggggggcagctgaaccggttcgccgtattttgaaacagctagtgctttaaatttaagagtgtagttaaatttattactcaagttggcactcgttattgtttgttatctgaattaaatacagtgataataaaataaataaagccctaattggggcttttttatattttaattattaatttgaacgcacttacatcaatgctttggtaggatttttttgctagaaataaaaaactattttttcatcaacaaatcacaactttttcttcatcagcattcgcatgttcgattttaccgattacccatgctttttcgcctacttgttgtaataatgccaatgcagtttccacatcttcctgtgggagagcgataatcatgcctacgccacagttaaaggttctatacatttcatagcgatcaatatttccttgttcttgtaaccatttgaaaataggatgccattcccaactcttttcattaattaccgctttaacggaagacggtaaaacacgcggaatattttcccaaaaaccgccgcctgttaaatggcaaatagcatgaacgtcagtatgtttaattaattgcaacaccggttttacataaatttttgtcggtgcaaggacttgttcagcgaatgaatgctcggctaattgtgctgttgtcggattaatacctgaaacttcaatgactttgcgaattaatgaatatccatttgaatgaggaccgcttgaagctaaggcaagtaatacatcgcctgctttaacgttggaaccgtcaataatttccgatttctcaactacacccacacaaaaacctgccaaatcataatcaccggtatgatacattcccggcatttctgcggtttcaccccctactaaagcacaaccggcttgcacacaaccatcagcaatacctttgatgacatctgctgcaacgtctacatccaatttacctgttgcataatagtcgagaaaaaataacggttctgcaccttgcaccacaagatcattgacacacattgcgaccaaatcaacaccaattgtgtcatgtttttttaggtcaatcgcaaggcgtaacttagtcccaacaccatcagttccggatacaagaataggatccttatatttacttggcaatgcacatagtgcaccgaagccccctaacccaccaataacctcgggtctagttgtacgttttacatcagatttaatacgttctactagtgtattccccgcattaatatccacacctgcgtctttataacttaatgattgtttactcacaattgaatcctaaaattagtatcgttattaaaataagcgatattgtaacacgctcaggcaatcgttttcgatgaattttgtaaagaaattttatcttttattcagcaaaagcgtgttgaaaaataaccgcacttttcctcgtctaaaaacgcagaaatgattatctaacgaattttcctgaaaatgatttaatccattagaaaatcatgcaaaatctctgcggtaaattctttccgcaaataaaatcctaaaggcaaagtatcgattatttcgccatttttaccgattcctttggttaacgctcgactatttgcccctttgggacggagttgcaggacctcaccaatacgggctgtaatttctgtgagcttacccagcacaatataatccatcaattcttcccaatcttgacgcagacgttgttcttgagaacttgatggctgccacaaaattggtacaccgacatggcgttcagcaagcggaatttgacgttcaccctcaataggaatccaaagcactttggataatttatatctgacatgagaagagtgccacgttacaccgctattttgggctaaaggtgccaaacttacaaaagtggtttccagaggataaccttgttgattaacaggaattgtttttagctcaatacctaaatggctaaaatcttgttccgctttgcttccggcagttgcacccagtgcggtttcaataagcattccgacccagcctttatctcgcttcaaatcgggaggcacaaccaaatttaactcttctgctaattcagcaaaggttaaacctgcaatagattttgcacgttgtaacagttcagcttcgtgttgagggggagtaagtgcggtcatgattgatgatatttttgtaataactttggtttcacgtattcaatgcctcgatcaatataatcaattttttccaattgcaataaatagcgttttgccggcaagcctccgccaaaaccagtaagttgcttttgttttcctaaaatacgatggcaaggaataataatgctaatcggattacgtcctacggcaccgcccactgctcttacggctttcggatgatcaatgaaacgtgccaattctccgtaactggcggaatgcccatatggaatttggcgtaaagcctgccatattttttgttgaaattccgtgccttgcggatgtaaaggaagatcggaaaaatcttccgcttccccgttaaaataacgatctaatgccgatgttacctgcaaaaagagcggtagattttgattaaaaatccaacgggaatttggctcaatttgttctaattcaaaatcaagatttgtcagctgattattttgcgacaacatcagcaatcgtccaattggcgaatgataataacaataaaaagtaggttgcataaaagaaaaaaggcgtattaacaaaatacgcctgattataacgaatagccgttagaaacggtagctaagatttaaaccgtacaaattggcacgtgctgttgatttatagtccgcacttactacggctaactgtacatttgtaacctgaactctattacccggataagatacagtatttccaatttcatatccctctttaaattgctgttttttaccacgtaaatgagcaaaacctacatcaacagaaagattaggcgtaaagttataggttgcacccaagctataccaagtgcggtcggtatcggggattgaagcactnggatggtcggcagactcatcataagcaatacctgcacgcagggttaatttatcattcacattrtaagtcgcccctagagctacacgtgaactgtcatgaaatttttcatctttatggaaagcgaccttaccgttatcataagtggcatgtaaactttgtaaacggctccatttagtatatttatagctgtagtgcatggcgaatttttccgttaattggtggaaaccggaaatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttaaaattaatatctactttagaatgataggcaataccgatacggttaccttgattaaattcataracygcmccgatattccaaccmaatccccatgcattrttatcttgtaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggcataaaccgcatttaatcccacaccaatgcttaagcctttgctgatacgatatgaaccgcttaaatttaaattaatggaatttagctcggtagttccgccaaaaacaccggcttcgtaattgcttttatattggctttttaatccaaagttcacattcatcgccgcaccgacagcaaatttatcattaatgggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatttatattaattctagattgaacgtatacccccccccattgagaattgtttcgttttaaacaaactcattaacgctgggttggttgccacaacagcggcattatcagcaatcgctgcctcacccgcataagctcgtcctaaaccggaactggacacctcggcgagttggaaagctgccgcattggcataagttgtggataatgctagtgctgacgcaataagcgttggcgtaaaaaagttttttgtgaatttcatttttttcataagcaatatagataatcttagttgttaaaagtccatcgaattctaaaacatggttatgacatgagcaaataagtttacgccattaggtaagaggtcagatcagttaaatagggtttatcttttttaacctgttacattttatgacaaaaagagcggtccaaattggcttggaagttggagcaaaattaaaatgatgttaaaatttcaccaattttttaattttaaatcaaggaaataacgatgtcagaaaatgtattgaaatgtactccggaggaaactaaggcttgttgttgtgcagatgtgggaacgattatagataattcggaactcagcgtagacttttctcaagtctatgaaaatgaaacaacagctcaagaggcattggcatatttaacggaaaaagccagaaaagcggaaacggaatcttgtgacattcgtagcgagattaaggaagtaaacggcaattatcagcttaatgcaacgtttacttttagctgtcaagcagaaacgctgatttttcaattatctataagatgattgaacaaatgaggaatcgaaaaaggatcatgttgcccgtagcacgagttaaggcaatatgtaacgatcaagaattgtaacttgttgagaacgtgttcagaataggaaaatgttcaaataatgaacaccccatattacgtcgaggaaaataaatgttttatattagaaaagccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttatcaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggcactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaaaaatttttgggattcaatgttgagcaaattcaatgttcaagcaaaataaaaatgcctgtctttgatatatttcaaaagcaggcatttccacaatgttcgagtaatgcttaaaaactcaccgcacttttcagttttttcaacgcatttgtttcaagctgacgtacacgttcagcagaaatgttatattttgctgcaagatcatgtagtgttgctttttcatcatctaaccagcgtgatttaataatatctcgactacgttcatccagttcagctaaggcgttggcaacctgatctgctgcttgtgtctcaaaattttcgttttctagctcagccgcaaaatttgagcttttatcttctaaatagagtgctggtgcgtaactttcatcatcatcaacgggtaaatcaaaaccgacgtcagatcctgtcattcgactttccatctcaaggacatcttctttggaaacgcccaattcatttgcaaccatatcaacttctttatcactgaaccaacctaagcgttgtttagttttacgtagattaaagaataatttacgttgtgctttagttgttgcgactttaacaatacgccaattacgtaatacatattcatggatttcagccttaatccaatgtactgcaaaagaaaccagacgaacaccaacttcaggattaaaacgtttcaccgctttcatcaagccgatattaccctcttgaataagatcggcttgcggtaaaccataaccggaatatccacgtgcgacatgaataacaaaacgtaaatgggacaaaatcaatgtttttgccgcatctaaatcttggtgatagtacaaacgttccgccaattccttttcttcttctgcagtcaacattgggtaatcataggctgcgtggatataaccttcgatactaccttgcggaactaacatcattgcttgtgtttctttattcattctattcctttttgtttataaaagacttattttctctatactttaagacttttaattgttttaatcaattaatatcttaaattctaatagttagaccataaatacattaaaaagttttcgtgttattttaaaattggcacaagaacatattctacattttgttcaattacttgcaataataaatcaatatttgggtgcttccccggattttctttagcatctaaaacatgttcggcaaatagttgcacgcctttttccgcacaagtgcggtctaatttaccgttaaatttttgagccaacgcattataaacacgcaaagaacctaattttccctgctcggcaggaatatgatgcacgacttgatcgtttgctaatatatctaaaccggacaagtgttcaatactgggtaagctcgttaaaattgtttggaaatccattttatttctccattattatgaaatataagcagtactatccacttcaccgttttccccaataaagcgtacttccggtcgtaaatagacgttaaattttagtattaccgtttggtgaatatgctgtgctaatttaaccacatccgcactacttgcattatctttattaataatgacgagtgcttgttgctgatgaacagcggcaccgccgatttgatagcctttaagtccagcttggtcaattaaccaacctgctgctaacttaattgtgccgtccggctgtggaaaaaaaggtatagttgggtaatcttgttgtaaaagcgaaaatgcttgtgctgaaataatcggatttttaaaaaaactaccgctattaccaaactcatcgggattgggtaatttgctttggcgaatatgacaaatttcagcaaaaatttcttgtgcgttgacttgatgtgtatcgaattcagttaatgtgccgtattttaataccggttgccaattttttgctaattttagaccaactgcggtaataaaatacccttctctgtattgccttttaaaaatactttctcgataagcaaacgcacattcttcattgcttaaacgaaatattgtatttttttgtaaatccaatacgtccacataatcacaaacatctttaaattctacgccataagcaccgatattttgaatgggtgccgatcctgcacaacccggaatcaaagcgaggttttctaaaccataaatgccttgtgttaaggaccattgcactaaattatgccaattttctccgccattaacatgtaaataatgaaagtttgcatcttgcttatgttcaatccccataagctgattaataaatacaatgcctttaaaatcgtccacaaataaaacgttacttccttgtcccaaaaataagatcggcaaagcgttctttttcgctaatttccattgctcaattaactcggaaagtgcggtgatttttataattttttttgctttagacggaagatgaaatgtatgaaagtcttgtaaattttccattaatattccttaaaatgtattcggtaaagttaatttcacttcggtaccgcctgtcgaatgattttgaatagacaaacgtgcatttaattggttactgcgttctaacataatatttaatccataatgcccggttggttcctttaaacttggaataccaatgccattatcacgcacagccaattcatattcaccgtcatcattagtataagccagcacttcaatttctgtgccttgtgaatgtttaatcgcatttaatgtcgcctctcgcacaatttgtaacgcatgaactagttgttgggcgttaaatgtttgtgaaggcaaagaacaatccactcgcattcgcattgaggtttgattgcgtaatgaatctatcacttgttctaaagcaacctgtaaatttgcctcttgtatggttaagcggaatgtggcgagaagttcacgcaactgtagataaccggcggtaactgcttgctcaaaatcttgaataatttcttggcttttggctttggcatcttgagtttcttgttgtagggtatgttttaataaagtgagttgaattttcaaataagacaatacttgagccaaagaatcatgtaattctcttgcaataattgaccgctcttccatgagtaataaatgctgttgttgtcgttgcatttggtaaaaatacagcgtgcgactgagcatttgcgagacattgtgcattgtgcgtaaatccggacaaggtaagccggcttgccaacgcataatcccaagttgattattttcgatttctaaatccatactttgtaaatcaacggggtcttgttttgttcctaaagaaatatgccaatgctctgcaccatgaacaattaattctaaataccgcaaatgttcattaatcatcacttgttttagcatttgttgaaatagtttaggttcaatggcttttgtagtaacaagttgagaacaatgataaagcatggttaaagagcggttagcttgacttaacttttgtgttttctcattcactttttcctccaacgtggcataaagtttttttaactcggctgccatttgggtaaaaactaaagctaatcgaccaatttcatcatcacttttggtgtctaacggaatatggttaaattgtccaatttgaacttgagaacttgccaacgctaatttttccaatggggtaacaactcttttgcgtgtaaaataaatgacataggataccatagctaaaatcacaatcattgctactaaaatactgagtacggcgattttaagtttcagctccgcaaaatactgtaaagtatttacaaattgatctacttgatcgacatagctggcgatttctgcacggtaagcatccttgttgttttcttttgcatgcttttccatgatctcccaacgcttgattaaattacgataggattgccttacatcattaggtacaagaaaatgccgactaattttgagtaatggctctgaatgcaaacttaaacgatattgacgcaatgccctctctacattgtccggttcatattccatttcataaaaaagtcggtaactttgcatacgtaatgagccggaaacattgattaactctgcatcagatttattactttgcataatagctaaactcattatgctaattaacgatacaaaaataatgatgagcaataaatagttggcaattttagttgaaacagaatgattttttatattcatataaacgtttttaagcaaaaatctcaccctatcatacaacagaatgtattgaataccgcatactttattattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatttgatctacctcaacaaacttacattttgtcgagcaaatactcatttttggttattaaaaatcagcggtaaggtttggacaataaaaatctataaaagaatagtgtggtttttaggcataacgttggtggaagaacagttatccagcaacgataacaacctcaaaataagaaagaatatgaaagaaaataagaacgcaaaaaatcatgctgaggagtggcatgtttgtggcttaattattcaagtaaacccacaaaaaatagcacaagttaagaccgctcttttgactattccgcatacggaaattccagcagaggatgaaaaaggaaaattggttgtggttatgcaatcggacgatccgcaggttttactgaatcatatggaaaattcacgcaatattgatggcgtgattgatttgtcgctgatttatcatcaacaagatgacaatgttgagcaataatttaaaaacgaatagtgggggagactatgaatttaagtcgtcgtgattttatgaaagcaaatgctgctttagctgccgcttcagtggctggcttaattattccggtaaaaaatgtaaatgcagctgacacaagtattacttgggataaagccgtatgtcgcttttgcggtacaggatgtgcggtattagtggggacaaaagatggacgtgttgttgcttcgcaaggtgatcctgatgcagaagttaatcgagggttaaactgtattaaaggttatttcctacccaaaattatgtatgggaaagaccgtttaacgcaccctatgctacgtatgaaaaacggtcaatatgacaaagaaggggaatttacccccgtaacttgggattttgcctttaaaacaatggcggaaaaatttaagtctgcattaaaagcaaaaggaccgaacggtgtaggtatgttcacctccggacaatccactatttttgaaggtgtggcaaaatcgaaattattcaaagcaggattactttcaaataatattgatccgaatgctcgtcactgcatggcatcggcagctgttgcctttgtacgtacctttggtatagatgagcccatgggctgttatgatgatattgagcatgccgatgctttcgtgctttgggggtcaaatatggcggaaatgcacccgattttatggtctcgtatctcggatcgccgtttggctaatcctgatacggttagtgtaaatgtcctttctacctttgagcaccgctcttttgaacttgccgatttaggtattcttctcaaacctcagtctgatttggctattttgaactatattgcaaattatctcattgaaaataatgcaattaatcgagagttcatcgaaaaacataccaaatttaaacgtggcgaaactgatattggttatggcttacgtccacaagatcctcgtgagcaaatagcgaaaaatgttaaaactgcgggcaagatgtatgatagttcttttgaggaattcaaaaaattagttgcaccgtacaccttagaaaaagcacatgaaatttccggagtaccgaaggagcaattagaaaaactggcaaaactttatgccgatccaaataaaaaagttgtttcttattggacaatgggcataaaccaacacacacgtggtgtatgggcaaaccatttaatttataacattcatttattaaccggaaaaatttcattaccggggtgtggtcctttctcattaacaggtcaaccctctgcttgtggtactgcacgtgaggtgggtacttttattcatcggttaccggcggatttagtagttactaaaccggaacatcgtaaaattgcagaaaaaatttggaaactaccggaaggtttgatttcagataaattaggcttccacgctgttgcacaaagtcgtgcattaaaagacggcaaaatgcaggtgttatggcaaatgtgtaacaacaatatgcaggcaggtccaaatatcaatgaggaaacttacccagggtggcgtaatccggataactttattgtcgtttcagatccctatccaactgtatccgcactttcagccgacttgatcttaccaacagcaatgtgggttgaaaaagaaggggcttatggaaatgcggaacgtcgcactcaattttggcgtcaacaagtgaaagcaccgggtgaagcaaaatctgatttatggcaattagttgaattttctaaatattttacgactaatgaagtatggccagcagaaattttagcgaaaaatccggcataccaaggtaaaacactttatgaggtgctttatctcaatggacaagtaaatcaatactcaaatgatgaactgaaaggtcgcctaaatgatgaggcttaccattttggtttctatatacaaaaagggttatttgaagaatacgcacgttttggtcgaggacatggtcatgatttagctgattttgacacttaccataaagctcgagggttgcgttggcctgtagttgacggtaaagaaactttatggcgttatcgtgaaggttatgatccttatgtaaaagcaggggagggtgtttctttttatggtcaggcggataaaagagcggtgattttagcggtaccatatgaaccgccggcagaggtgccggatagagaatatgatttatggctgaccacaggtcgcattcttgagcattggcatacaggctccatgacacgtcgtgtaccagaattacaccgttctttcccgaataaccttgtttggatgaatccgaatgatgcgaaaaaacgtggtttgaaacatggggataagattaaggttatttctcgccgaggtgaaataacgtcttatatagatactcgtggacgtaataaatgtcctgaaggtttgatttatacgactttctttgatgccggacagctggcaaataaactgatattagatgcaacagatccgatttcgaaagaaactgacttcaaaaaatgtgcagtaaaagtggtgaaagcgtaacaatcaacaaaaggcaccgcactttacttgctaaagtgcgatgaatattcatgaagaaaattgcttttacaccggaacgccgaaaatttttaagagataccgcccgaacctgtggcggacttgccggattaggcgtattacttggcttacaacaacatcaaagtctggctagacagggtgtggcattacgtccgcccggtgctttggctaatgaccaagattttacagcggcttgtattcgttgcggtcaatgtgtacaggcttgtccttataaaatgctgcatttagcctcattattatcttccatagaggctggaactccctattttattgcgagagagaaggcttgtgaaatgtgtgaggatattccttgtgttaaggcttgtccgagcggtgcattggataatcaacttgatgatattagtaaagcaacaatgggattagccgttttgcttgatcacgaaacctgtttaaactggcagggtttacgttgtgatgtttgttatcgtgtttgccctttaattgataaagcgattacgttggaaactcatcgcaatgagagaacaggaaagcatgcagtttttatccctactgttcattctgatgcctgtacaggttgtggtaaatgtgaagaggcttgtgtattggaagaagtcgctatcaaggttcttcctaatacattagcaaaaggtatgttgggagaacattatcgtttgggctggcaagagaaagataaagtagggcattctcttgcacccaaagacttaatatccttaccaattcgtcaaccggagagtaaataatggcaaattctcctaaacacagcggtaaagaatcaagagaaaaattaggtttttggcgtgcaaaccggttcctcattttacgtcgggtaactcaattcagcattctcaccatgttcttgagcggaccttatttaaacttttggattctaaagggtaattatagtggtagtttattattcgacactatcccattaaccgatccgcttattgtcgccgaaagccttgcaacaggctatttaccgaacagttcaacgattattggaacaattattgttgtatcaatatatgctttacttggtagcaaagttttttgtggctgggtttgtcctcttaatgttgtaacggattgtgccgcttggttacgtcgaaaattaggtattcgtcaaagtgccaaacttcctcgtggcttgcgttatggtattttgctgatgattttaatggggagtgcagtaagtggcgtattgttatgggaatggataaatcctgtttccgctttgggacgtgcgttaatttacggggttggtgcaacaacttggttgatatcggcagttttcttatttgacttatttattgtggaacatggctggtgcggtcatctttgtcctattggtgcaatttatggtgtgattggggcaaaaagtttattgcgtattaaagtagttgagcaacaaaaatgtgatcactgtatggattgttaccatatttgtccggagccgcaagttttacgtgcaccgctacacggtaaaaataatgaaagtcggtttgtactttcaaaagattgtatcagttgcggacgttgtattgatgtctgtgctgaaaaagtatttatatttagcaatagatttaatcattctgggagtgatcaaaaatgatgaaaaaaacactattatttattaccgcactttttgtgtcttctgcttttgcaacgcagaaagtgggaaaaaactaccaagatgctgttgaaaatgtgccagctgcatttcataaccatataaaagaaagtacaacgcccgcattaaactatgtaaatcaaccacctatgatcccgcatagcgttgcaaattatcaagtaacaaaaaatacaaaccagtgtttaaattgccatagtccggaaaactcgagaattaccggagcaacaagaattagtccaacgcattttacagatcgtgacggcaatgttaccggtcaaactgcaccacgacgctatttctgtttacattgccacgtatcgcaagcagatgttgctcctattgtgccaaatgaatttaagccaatgaaaggctatggtaactagatgaggatagatgtatggcaaatgaaaaatcaaatatcatcgttcgtttaagtaaaagcggttggaaatggtttaagaagccaagtcgtgctatcagtgtattgattttattatcatttattgcaggtattattttttggggcggatttaacaccgcacttgaatacacgaatacggaagaattttgttccagttgccatatgaatgatgttgtacctgaatatcgtcattctgttcactatatgaatcgcagtggagtaaaagccgactgtgccgactgccatttaccgcacgaatttattccgaaatggacacgtaaaatcggggcggcaaaagaagtttatgcgtatattacaggcaaggtagataccaaagagaaatttgaggcacatcgcttagaaatggcacaacgtgaatgggctagaatgaaagccaatgactcacaagaatgtcgtcattgccataatttcaatgatatggatactactcagcaaaaaaatgtcgcacaaaaaatgcacagaatagcacaagaacaaggcaaaacctgtattgattgtcataaaggtattgctcaccaattaccgaatatgaaagacgtgcaatccggttttttacctgagcaatagtgaaaaaattgaccgcacgttgagttgcacctcaaacgttggataaatccgactgattgaggtgcaacattgtgactatttgattttaaattatttatcctaatgcaactctcgcattttggaataaacgcatccaagccccgtcttcttgccaattttcaggataccaagaattgtttactgctctaaatacacgctcagggtgtggcatcataatagcgactcgtccgttggaattagaaagtgcggtaattccctccgcagatccgttcggatttgccggatatatttctgtcggatttaactgactgtcgatatattgtgcagcaatcaaattctgtgcttttaatgcttgcaactgctgatcatgcttaaattcaattcgtccttcaccatgagaaaccgcaatcggcatatgtgatcccgacattccgttaaaccatacggaatgagtatcgttaatgcgaaccattgcaacacgagcttcaaaacgttctgatttatttcgtacaaatcgtccccagttttccgtaccgggtataatttctgctaaattggataacatttgacaaccgttacaaacacctaaggctaatgtgtcctgacgatggaaaaatgcactgaattgatcacgaagtgcagtgttaaacagaatagatttagcccaaccgccaccggctcccaagacatcgccataagaaaatccaccgcaagcaacgagtgcgttgaaatcctgaagatgatgacgtcctttttgcaaatcactcatatgaacatcaatggcattaaatccagcacgatcaaaagctgccgccatttcataatggctgtttaccccttgttcacgtaaaatagcaatacgaggttttgttcctttttggatataaggtgcggtgattttttcatttagatcataggtcaaataagcggaaagtcctttatcattcggatcttttttcatctcaaattcttgatcggcacaatctggattatcacgtaaacgttgcatttgatgtgttaattcagcccaaatcccacgtaatacggagcgtttttcactcaataagactctggtactgcgagtaatctcgatatgatcatctgcggtaacaataccgagttctttggttaaatgaattaatccatgttcggtcaatacggcacgcaccgctttaaggtcactttctttgacttgaattacggcacctaattcttcattgaataaaacaccgagatcattgtcacccaatgcactgatgtctatggaaataccgcaatgaccggcaaaagccatttccgcaagcgtaacaatcaaaccaccgtccgaacgatcatgataggccagcaatttctcttgtttcacgagagcttgcattgcattaaaaaagcctttcagcaaagacacatttactacatctgccggtacatcgcctaattgcttatacacttgagcaagtgcggttgcacctaaacgattttttccctcacctaaatcaattaatagtaatcggctatctcctttgtccatacgtaattgaggtgtaaccgtcttacgcacatcttctacacgagcaaacgcactgataattacggaaagcggtgcggttacggatttttgatatccttcttcctgccaagtggttttcatagacatggaatcttttccaaccggaatggttaaacctaattgagggcataattcctcaccgattgcttttacagcctcataaagtccggcatcttcgccgccatgacctgcggcagccatccagttagcggataatttaatccgtctaatatcgccgatatccgttgcggcaatattggtaatgctttctgcgacagctaaacgtgcagaggcggcaaaatccaacaaggcaacaggagttcgttctccgatagacattgcttcaccgtgataactgtctaaacttgctgttgttaccgcacaatccgccacaggtacttgccacggaccgaccatttgatcccgtgctaccatacctgttactgagcggtcgccgatagtgattaaaaatgttttctctgctacggcaggtaaccgcaataccctgaacaatgcttctttaatttggatcatagactgatccaattggggattattgacttttgcggatttcacatcacgtatcattttaggggttttacctaacaagatgttcattggtaaatcaataggattgttattaaaatggctatcttgcaaagttaactgctgttgttccgttgcctcaccaatcaccgcaaaagatgctcgctcacgctgacaaatcgcttcaaagagcggtaatttttctggtgaaacggctaaaacataacgttcttgtgattcattgcaccaaatttctagcggcgacattcctttttcatcgcataaaatttctcgcaacgcaaatcgcccacctcgaccaccgtcatgaactaattcaggcatcgcattagataacccgccggcaccgacatcatgaataaaaagaatggggttttctgaacctaattgccaacaacggtctattacttcctgacagcgacgctccatttccggattatcccgttgtacagaagcaaaatccaaatcttcttttgactttcctgatgccatagacgaggctgcaccaccgcccagaccaatattcattgctgctccgcctaacacaattaatttcgcaccaacaggaatttcgcctttttgcacatgttcatgacgaatattacctatcccgcccgccagcataatcggcttatgatagccccgcacttcttcgccgttaaaactgttgactttttcttcataagtacggaaataacccaataaagcaggacgcccgaattcattattgaaagcagcaccgccaagcggaccttcaatcataatatccagtgcggaggcaatacggctcggtttactcaacgcattttcccaaggttgcggaaaattcggaatacaaagattagacacggagaaaccgactaaaccggctttcggttttgcaccacgtcccgtggctccctcatcacgaatttcgccacctgaaccagttgcagctccggggaaaggtgaaatggcggtagggtgattatgggtttccactttcatcaaaatatgcgtgtcttcttgatgataacgatattgcccgtcttggtcagggaaaaagcgtccgacttttgaaccttccatcaccgcagcattatctttataagctgacaatacataatcaggcgttttctcaaaggtgtttttaatcattttaaacagcgatttatcctgtttttttccatcaataatccaatctgcattaaaaatcttatgacgacaatgttctgagttcgcttgtgcaaacatataaagttcaacatctgtaggattgcgaccgagtgcggtgaaattttccactaaataatcaatttcatcttttgctaatgccaatcctaaagtcacattcgccttttccaatgcaacatgcccaccggttaaaatatctaccgtggtgaaaggttttgggtcatgctgttcaaataaaacagctgcttcttgtggagaacggacaatactttccatcatagggtcgtagatacggaatactaattgttgttgttcttcagccgttaaagtgcggttaaatttgaaataataagcgataccacgttccaaacgaagtaccttatttaaatcacaattatgtgcaatatcagttgcttttgatgcccaagaagaaatcgtacctatacgtggaatcaccacaaaacattccccataaggctcttgcgatttctgagtcggaccataacgcaaaagctcctctaatttttctctttctacctcagttaatgcttcacttaaatgggcaaaatgcaaaaattctgcataacaagacacaatgggtaaattatcttgctgaaaaccactgaataactgatttaaacgaaaattggataatgcgggcgtaccacgaaaaatgtgtaacatagaaaagatccatcaaaaaaataaaaaacgaccacattataaaggaatttttatcggaacgaaaacgtttgcctaatgcaattttcaaaaaatagttaataaaaagctgataactgaaatgatctgcactccaaaagttggattaaacaactaactgatgaagtgcagatttttttaggattaattttttggtaaatatctcattggatctactgattgacctttataacgaatttcaaaatggagtttgattgtgtttgttccagaacttcccattttagcaatttgttgacccgctttaacttcttgctgatctttgacgagtatactttcattatgtgcataagcacttaaataactgtcattatgtttaataataattaaattaccatatccacgtaaagcgtctccggcatatacaactcgtccagcagcagctgcattaacagcttgtccacgagaaccgctaatatcaatacctttattgcctccatcagcactggaaaatccttgaataatttttccatttgttggccaaatccaagctatatttgaggtggctggaggtgttttattgattggcattgttgaatgtgttggtgtagcaacggatttcatttgttcatttgttggtttattagcattccatgtctcattgactgtattttgtgtcacctctgattcatttattgtctgtgttggtatcatattgctatcgggaatattatttgcaattttcaatatttgtccaatactcagatgatatggttcagacatattatttagtgtggccaattcttttatatccatgcctgaaatataagcaataagaaacatggtatcgcctttgcgtactttgtaagtatcacctttgtaaaaacccttatcaattttgctataaacaggcacattagttttaggatctcttggaatttcaaaattttgtagagcctgtttttttgctatcgattctgttttttgttgattttgttgaatgatttcaggttgataagtggaatttgttgctttcggcactctcatactttcgggcatcttttgttgaataacttgaggttcccaagcggttgagtttgtaccattaatcggtttgataatacttggtgctaaatccttagcattttctaccggagccggagtgtgtgaactacaagcagctagtacagtgatactaatagataaaggtaaaaattttttcatgtaaattctccgttactttatattcattttttatcttagattatttcaagacaagatatacaactatagcaataatgacaactgaccaaccgataaattcaatagattgacgtaatttcgcagcaaatttttttccgctccaagccgctaaatgggtaacgagcaaaaatcttgcaatacgagaaataaaggcagtaagtaagaaaggcaaaaatgccatttgcatgacgcctgcacaaatcgtaaaaattttataaggaataggtgaaaaacctgcaacgaaaactacccaaataccccattctttgaaccaagaaagagcagtttcccaatgttgttgataaccccattgttgaatataactttgtatgaaatcaaaagcgtaataacctaatccataaccaattgccccaccaatggctgaagccattgctgcataaaatgcaaatttagtagcacatttaggtttatttattgacatcggaataagcatgacatcaggtggtattgggaagaaaatagcctcaataaaactaacaaaagttagccaaaatgtagcaaaacggtgatttgcccattgcatagttttatcatatagcgtaccgaaaattttcatgttttattccttcgatgaaaagattatcgttattccttatctaaccattgttgtaaagctgtcattgaatgatatgccgtcatatctgtttgaatgggtgtaattgacacatagccgtttttaacggcatggaagtccgttccttccgattcattttctgccagtcctattggtccaatccaataaatctcttcacctcttggatctttttgtttaataatatccgctgcagctgcacgatacccaagatgacaaactttaataccttttatttctgaataggggagatccggcacattaatattaataatttctcggctttttaataatcgtccatatagtttaggaataagttgactcacaattattgccgcactttcataatgttgtcgtccatctaaagaaactgcgattgcaggtaagcttaaatggcgaccttccagtgcagctgcaacagttcccgaataaataacgtcatcacctaaattgactcctgcattaatacctgaaacgacaaggtcgatctgaccggataaaaaaccgttgagtgctaaatgtacacaatctgcgggagtgccattgatactataatcaccattatccaatttcattggtcgtaaaggctcaacgagtgtgagtgagcttgaagcagcactacgattacggtctggtgcaacaacagtgacttgtgcaaatttacgtaattctttagcaagagttttgattccctctgcctgtatgccatcatcattagaaagcagaatatgcatattgtttcctatgttttaaattattattcattaatattaaccagttctcttacgagggctgtcgcataacttcctgctggtaaataaaaagtcagttttaatccctcaggtataaatgaccagcttaagtgttgagcttgcataagtattggacgacgtgccgatttcattttttcctggtgcattaagtacaggagttcttgatgtttagcgataatttcattttctacatcactggcaatttgtacattttcaccaattaatggtgcagtgatttgaatatcctgttgtgctaaacgttgttgtaataaattaaaatcttctttttgatcagcatggaaccaactgtgtgagccggataactgcaaaatatcatttactaagattttatggtgtagaccttgtcgaatacgagcggatacaatcaagttaaaaatttcactacgagcagcggagagataaaaactacgctttttgcgatctttaacgttaatttcacctttagcccagcgtaaagcctgagttaaattgtgtccatctcgtccgaaacgttgctcggtaaaataatttgggaacccatttttcttgatattttctaaccgcactttgagatctgcatcttcttgtgcttcacgcagtaaaatttcaaaatggtttccgtccaagcttcctgtgcgaatttttcgattgtgacgtgttacctcaaggatttccacaccatcaagttgaaattgattaaagtcaggtgtgggttgtcccggcatctgtaaacaaaaccattgttctgtaatcgctttacgatctttgagtcctgcatatcccatatttttagcaggtataccagcaaagtgtgccaatttttctgcgacaaatagagtattacaatctgttttacgcactttaacagcaacaaattcgccatcaccggacatttcatagcccagttgttctttcacaacaaaatcagcacagtgtgtttttaaaagtgcggtctgttttggcattgtttgtaaataagcgagttcgttcattactttgtgccattttgttttattaataggacaacagcttcacaagcaatgccttcactgcgtccagtgaagcctaatttttctgttgtagttgcttttacattaacctgttcaatatcacaatgtaagtcctgtgcaatcacagtacgcattgagtcaatatatggacgcatcttgggagcctgtgcaatgatagttatatcaacattaccgacttgatagcctttgtctaaaattgcttggtaggctgttcttaataacctgcgactatcagcacctttatattgtatatcagtatctgggaataattttcctatatctcctaaagccattgcacccagtaaagcatctgttaatgcgtgtaatgccacgtcgccatcactatgtgcaactaaacctttttcataagggatagcgacacctccgatgataataggaccttcaccaccaaaggcatgtacatcaaagccatgaccaattcttatcatattttttcctaattaatgctcttttttcataatttgttggatttcagccatcatttcttggtcgacgtctaaggctatttgaattaattctttattttcaaagcgagagagttttggatcataaacctctgccattagcttcacgctatgacgatcttttctaaagtaggcttcaccaatttctgtcactgtatcttcattcatacctaaagaaagtaaagcttctttacctgttcttaatgctgaatcaaaagtttcacgaatttgaatattggcacctgcaccatacagattgtaaacatgaatacggtcatgagcacgtgcaataattttaatttgtgggttcattttacgagcttgctcaacaatttgtagagtttgttctctgttatcaattgctataatcaataattcggcattttcgacacctgcagcatgtaatagctcaggacgagcagcatctccatagtagcatttaatgcctaattttttcataccggcaattaggtttgcgtctttatcaataatagttgggtgatgccccgtcatcactaacattctatttacaacttgtccaaaacgtcctagaccaattagtatagttggatgttgttcatcaatatgatccgcttttctttccggttgagtcggtttgagacgaggaattatgtatttcttttgagcaataataaagagcggtgttaaaatcattgaaagtacaacaatagctgtcatattcgcttgcatttcttcactaataacattttggctggcagccgcagagaataatacaaaggcgaattccccaccctgtgccataataaatgctcggtcaatagaattagcattaccggtttttgtgattaaagcgattaaataaattataaatcctttcactaacatgaaaactagtacaccaaaaataattaagaaccaattttcagcaacgacggaaaggtcgagtgacataccgacacctagaaagaacaagcctaatagcaaccctctgaaaggctcaatatcagcttcgagttgatgacgaaaactggattctgaaagtagcactccggctaaaaaagcacccatagccatagagaagcccccctcttccataagtaaagcagagcctagaacaacgagaagagcagctgcggtcattacttctcgagtcttggttttagccaacattttaaataatgggtttaagagccaaagtccggctgccactaaaacagcaaaagccgtgccggatattgcaattttatgccaaagcggatcagttgaagtaactttatccggcgataaaaaagccacaaaagcaagtaatggaacaatgagtaaatcttcaaagagtaaaatcgaaataatacgctgtcctcttggagaggtcagatcattacgctcactcagttcttgcattacaattgcagtagaagtcaatacaaaaccggaggcggcaacaaaagcaactttccaatcaaagccaaataaagtagcaatataagttaaagcactggtacaaagggtaatttgaaatgcacctaagagaaagatatagttacgtagtccccaaatatgagagggtttcatttcgagtccaatgatgaataaaaacatcaccacacctaattctgctatatggattattccctctggatctgtaaagagaccgaacccaaagggaccaataactaaaccggcggctaaatagcccaatactgaacctagtcctaagcgtttgaatagaggaaccgcaactacggccgccgctaaaagcgtaacaacgctaacaagtgggtttgccccttctgctaccataataattacctttgttttctagttaaaaaaaattctgccaatgccaagtcttcaggacgtgttactttaatattatcactatgtcctgctactaagtgcggtctaaatccggcaagttccatcgctaatgcttcatctgtgacgataatacctcgttttgctgcttgctctagagcgtgttgcaataagtgtacagggaaaaattgcggtgtttgtgccaaccataattgattacggtcttctgtacattgaatttgcaatactgaatttgatcgtttaatagtatctaccgcaggaatagctaaaatagcaccattttgatcttcaacttgtagtaatgtatctaaatcttcattgcgtaaacaaggacgtgctgcatcatgcacaagcacccaggcttttttatttttaatgtgacgtaggccgtttagcacagattccgcacgattctttccgccaataaccatattgatacgaggatttcgcaataactcaatatcaattaaataaggatcattttcagcgacagataaaacaatttggctaattttttcgcaactcaaaaaaatacttaatgtatgctctaaaattgttttgcccagtatctttaaatattgttttgggcgatctgcttgcatacggcaaccaatgccagcagcaggtattatagcaacaatttctctatccatttatctattcttattttttactatacgataaaaaacttcattttgcttgatcatttcatgttccattctagctctttcctcgattgcttctataccattcttcagatcctgaatttcagcaaaaatagtttgattacgttgtgacagctttttgttttcttgtttacgttggataatttctgctttgatatcttgataatcaagatagccattttttccaaaccaaaaatcatactgaaacataactaacaaagcgaaaagacttaaaataaataaacgcatttttatctcttatttttcataccaaattttatttatgtacaaagaaactatacctgagggagtggctactttgatttcgtcatcgacttctttgccaattaatgcccgtgctacagggctatcaatggagatccaattctttgcgggatcaaattcatcacagcctacaatgcgatattgtttttcctctccttgctcatcttctaaggcaacccatgcaccaaaaaagactttaccttcttgctttgggttatagtccacgatttgcaatacttccagacgtttcattagaaaacgaactcggcgatcaatttctcttaaacgacgcttgccgtaaatatattctgcattttcactacgatcacccaaggcggctgcatcggaaacagcttgcgtgattttaggtcgttcgtctttccataaatattttagctcttgatctagaatattccagccggaacgagtgatataattagatttaggcattgtatctttcctttcaaagagagcaaaattgtaacataagatcaataataaatatgtgaagaatagttaaaattacagttaattttacaattttttccaataattgtttgaactattacgttaaactcagtatgctaccgcgaattttttaaacagaatataatagaaatagagacaagatgttaaatcaacaaatcgccggtattattgcgaaagaactaactgttctgccaaatcaaattttatcggctatccaattattagatgatggcaatacaattcctttcattgctcgttatcgtaaagaaatgaccggtggattagatgatacccaattacgtcattttgaaacacgtttaatttatttacgtgagttagaagatcgtcgccaaacgattctcaactctattgaagaacaagggaaattgacagatgaattgcgtagtcaaattgaacaaacgcaaagtaaaactgaattagaagatctttatttaccgtataaaccgaaacgtcgcacaaaagggcaaatcgcaattgaggcaggaattgaacctttagctgatttgctttggaatgcacctgagaatgaaccggaaatcgttgcggcagattatatcaatgcggaacaagggtttgcggatataaaatctgtgcttgatggtgctcgttatattttaatggagcgttttgccgaagatgcacaattgttagcgaaaatccgccaatatttacagaaaagtgcggtactggtttccaatgttttagaaggcaaagaggctgagggagaaaagttccgagattattttgaacatcaggaattactccgcaatgttccttctcatcgtgctttagctatgttccgagggcgtaatgaaggctttttgcaattaaggttaaatgcggatcctgagcaagaagaaggtgttcgtcatagttattgtgaagaaattattcgagagcatttgggtattcatttaactcagcaaccagcggataagtggcgtgagcaggttatctcgtggacttggcggattaaaatctctttacatcttgaaactgaactgatgagcagtttacgtgagaaagctgaagatgaggcaattgatgtttttgcccaaaatctaacttcattattaatggcagcacctgccggagcgaaaaatactatggggctagatcccggtttaaggacaggtgtaaaagtcgctgttgttgataatacgggaaaattagtggcaacagagatagtttatccacataccggacaaatgaatacggcaatgtcagttatttatcaattaattaagcaacataatgttgagttaattgccattggtaacggcacagcttcaagagaaactgaacgatttgctaaagatgttattaagaaaattgagcaaaataaaccacaaacagttgtggtcagtgaagcaggtgcatctgtttattccgcatcagaattggcggcacaagagtttcctgaactggatgtgtctttgcgaggtgcagtttctattgctcgccgtttacaagatccactggcggagttagtgaaaattgaaccgaaagcaattggcgttgggcaatatcaacatgatgtaaaccaaactcagcttgctcgtaagctagatgcggtagtagaagattgtgtaaatgccgttggggttgatttaaatacggcatcagcacctttacttgctagagttgcaggtatgactaaacatcttgcacaaaatattgtggcatatcgtgatgaaaacgggcgttttgaaagccgtaatcagttaaaaaaagtaccgcgtttgggtcccaaagcctttgaacaatgtgctggttttatgcgtattgcacaaggtaaaaatccgcttgatgcctccggtgttcaccctgaggcttatcctgttgttgaaaagattttacaggctacggaaaaatctattcaagatttaatgggaaatgtgagtgctgttcgacaattagatgcaaaacaatttactgatgagcaatttggaatgccaacagttttagacattttcaaagagttggaaaaacccggaagggatcctcgaggtcaatttaaaacggcagtatttatggacggtgttgaagaaatcactgacttaaaagcaggtatgattttagaaggatctgtaactaacgtaacgaattttggggcatttgttgatatcggtgtgcatcaagacggtttagttcatatttcatctctttccgacaaatttgtggagaaccctcatgaagttgtgaaaacaggcgatattgtgaaagtcaaagtgttggaagttgatgttgcccgtaagcgtattggactaaccatgcgtttagatgagaatccgcccaaaaccgaccgcacttcagtcaaaacgacctcagtccatgtaaaagaagtgaataaaaatcggaaaagtagcaataatgttatgggaaatgcgtttgccgatgcgttaaaaaattggaaaaaatagttttagtacagggtatttgggtattaagttatgatgggtttaattatataacacaggaaattttatatgaataaaaacactttttttgtaggctttatgctgtttgctatcttttttggtgcagggaacttaatttttcctcccaagttgggatttgatagcggatctgaatttattccttctattttaggctttgtattaacaggggttggcttaccgctattgggcatcgttgttagtgcattttataatgggggatacaaagaggcacttaaacaaattcatcctgcattttcattaatttttttaattgcgatttatttatctatcggccctttttttgccggaccaagaaccggtgcaacagcttacgaatttgtgattctaccttttatgggggaagcaacatcaatttctaaactggtattctttgcggtctatttttcattgactttatggctaagtttaaatccgacgaaattagtcgatcgtatcggctctattttaacgcctattttattggtagcgattatcgcattagttatccgttctgtttttttattaagcggacatgatattccaagtgtaacggtgaatacatcaggtagcttttttaatggcgtgattgagggctactttactatggatgccctagcatccgttgctttttctgtggttgtgttaaatgctatacgaaataaaaccgacctaagtgtttcattaaaacagcaaacaatttttgctgcatttattgctgccattgccttgggtttaatttatgtagcattaggatggattggtaacaatatttcaattaatgcggatgtattagctgatttgcaagcgaaaaaacaagaccttggtacttacattctaaacgatgtaactacattagcttttggtgagttaggtcgtacgttgttaggaattatcgtttctcttgcttgtttaacaactgcggtaggattagcggttgctgtgagcgaatattttaatgagatttatccgaagatttcttacaaaacctatgttgttttattttgtttagtgagttttgtaattgcaaatttaggcttaaaagaagttattagtttatcattacctgtattgctaatcctttatcctattgcaatgacagtgattttgttgctttttgttaatattattttcccgacgccaattttagctcatcgcttatctttaggattggtgactgtcgtgtctgttttatcggtatttggggttggaaaaattgagtttatcgagcaacttccactaaaaccttactctatggaatggctaccttttgcattggttggatttattttaggatgttttttacacatattcttcagtaaagaaaaatcagtgttaaaaagataagatataaaaatgagggcatattcaatgcccttattttctagtagtaagagtgttcgccccgctggtgttcagttacgtcttttacacctgtcaattcatcggcaaacattgctaataattgtttttcaatgccgtcttttagggtgacatctaccattgaacagccattacaccccccgccaaattgtaaaatagccttgccatctttggtaatttcaatcaaggtaatatgcccgccatgtcctgccaattgaggattgatttgcgtttggatagcatattccacacgttcaatcaatggtgcatcatcagctactttacgcattttagcattaggtgcttttaaggttaattgagaccccatttcttcagttatataatcaatttcagcatcttctaaaaaagggaaactgacttcatctatgaaagcagaaaactcactgtattttatttcatgatctgttgtttctacggcatttttagggcaataagacacaccgcattctgcattaggagagcctggattaacgacaaaaattcggatatttgtaccttcttcttgttgatctaaaagacgacgaaaatgtgcttgtgcagcctctgaaatggtaatttgcataaattaatattcctagcaatacttgagtaaaattatcaggaatgatactcctagaccgctcttttttccagtaatattacttagtttttatgttaagtttttgccagtccccatacatgaataacgttaattcctgcttgttttaatagttttgctatttcatttaatgttgagcctgttgtaataacatcatcaattaaagcgatggaatgatattgttttgctcgcttaatattcacgctaaaagcgttgtgtaaattagatcgtcttgctttttcatttagtcctcgttgcatttttgtgtatttttggcggacaaccagtttattatccagtggaatcgaaagttggcgtgaaagttgtttagcaattaagtacgcttgattataccccctgtaccattgacgaaaatgatgtaacggaacaggaatgatgacttcaggcaaactgaataaatactctcttcttgcatggtaaatcgctaacaacattaattgtgccaaagtgcggtctaaataatagcgattttgaaatttgaattgatgaataagtgtggataaaggtggttgatagcgtccaataactaccatttgttgccaatttggtgattgttttgcacaattcccacaaaacatctgtcctctaaaggcttgattttttgataaaacagcaccacaacgtccacaataatttaagcgagaaatttgtttatcacattgataacacaaatgacggtgtgcaaaatttaacggtttttgacaatggacacagctaaaattaaaccagttcacttaagttataacctccagagtggaaaaaagtgcagtattccattcaggaaaatatagatcaaaagattagggataatttctcgatcttaatcacaaaaatgctagaattagccaggctaaactaatcattttatgaaggaaaatttatgtctttaactgactatcgtgaaaaaattagcatggtattttttgatattgacgaaaccttattttcaaaagaaaaagatcatttaccggcaagcacttattttgcattaaaatctttgcgtgaaaaaggtgttttggtaggtattgcgacagggcgtgcacgctgtacttttcctgccaaaatcaatcaaatgattgatgaattagggattgatatttttgttactgccaatggacaacatgttgagtatcaggggcggatattagcccgttatgcaattgacaaaaataaattgtacaaactggttgagttttttgatcaacatggcattgattatgttcaagtagcgaacactgagattaaaatttccagcctcaatccaatactcactgatgcttttaatccaattagtacgaattatcaagtagatcctcgttattttgaacggcatgatgtattacaaattttgtcattctatgaggataaaagctacgatgaattaattgctcaatctaatattttagaaggattaaagacagtgcgttggcatcctaattcagtggatatatttgataaagacggttcaaaagcacggggaatccaagttgttgttgagcatttagggttgaatatggaaaatgtgatggcatttggtgatgggcttaatgacatagaaatgctaagtgcggtcggtgttggcgttgctatgggaaatggtcatgaatggttaaaacaacaagcgaattatgttactgatcatattgaagaaaatggcatttataattttttacataaagttggtttggtgtaattttaacaaggttaaataacttataggtcgctttttattttctcggcatcattatcctcagtaagaattcaccgcacttttctattagctatgataaacttattgcccttttaggttgatgatgagtgtttatgaagaaaattttattcattgtattgttgtttttgtgtggtgcaggcggtagcgttttttgggcatattggcaaataactgactttgtaaaacaacctgttaaagtcaaagaagagcaacttttaactgttgtgcgaggaacgaccggcaataaattggcaatattattagaaaatgaagggttaatcgaaaatgggaaatggttgccttggctgcttaaattaaaacccgaattgaataaaattaaagccggtacttattccctcgttaatgtagaaaatattcgagatcttcttgatgtacttaatcagggcaaagaggtgcaatttaatttgcaattgattgaaggacaacgttttaaaacttggcgtaaaattttagaaaatgcaccgcacttgcggcaaacattacaaggaaaatcggagaaagagatttttactttgctggagttgccggcttattcaaaagctgtttatgaatggaaaacgattgatggttggttatatccggatacttatagttacacgcctaactctagcgatttggcactgttaaaacgtgcggcttcccgtaccataaaagcgttagagcgagcttggcaacaaagaaatgtaaatttgccattgaaaaatccctatgaaatgttaattcttgcttctattgtggaaaaggaaacagcattgagtgaggagagagcgaaagtagcgggcgtttttgtgaatcgtttaaataagcaaatgaaattacaaacagatccaacggtgatctatggtatgggtgatgattataaaggtaatattcggaaaaaagatttattgacaccaaccccttataatacctatgtgattgatggtttaccgccgacgccgattgctatggtaagcgaggaaagtttacaggctgttgctaaaccggaacagcatgattatttatattttgtcgcagatggaagcggtggacacaagtttagtaaaacattggcagaacataaccgtgctgtgcaagaatatttgcgttggtaccgttctcaatcaaaatagtgaaataaaatgaaaacaggaaagtttattgttattgaaggcttagaaggtgcaggtaaaagtagtacacatcaagttgtggtaaatacattgacggagtttggtattcatgaagttatttttacccgggagccgggcggtacgcctttagcggaaaaattacgttatcttattaaacatgaagccgaggaacttgtcacggctaaagcagaattgctcatgttgtatgctgctcgagttcagctcgtagagaatgttataaagccggctttagcaagaggcaaatgggtagtgggagatcgtcatgatttatcttcacaggcttatcaaggaggcggtcgaggtttggatcggcatttgatgacaacgttaaaaaatgctgtattgggcgattttaagcccgattttacgttgtatcttgatattgaaccagaaattggtttagcgagggtaagagggcgaggggagttagatcgtattgaacaacaaaatttagatttttttcaccgcactcgagcaaggtatttacagttagtgcaacaagatcctaatgccgtattaattaatgcagatcagcctattgagcttgtgcagcaagatattcgtaaagctgtgcaaaaatttattgaagaaaatgtgtaatttatatccttggttacaaccttattatcaacaaattatccaaccttttttacaagagaaagggcatcatgctttgttatttaaagccgaacaaggaataggtatcgagcaattgattgaaaatatcgcaggttggttaatgtgccggcaaaaagatgccctacaatcttgccgacaatgccaaagttgtgcattattcagagcaggaaatcatcctgatttttatcgacttgaatctcttgacaataaggatattggtgtcgagcaagtgcgagaaatgaatgaaaaagttagtcagtttgcaaaacaaggcggaaataaagttgtgtttattcgtcaagctgaacgtttaactgaaagtgcggcgaatgcgttactaaaaacgttggaagagcctagaccgcatacttattttttattacaaatggacttttcggctgggttgttagcgacaatttatagtcgttgtcaagcttgggttattaatacgccaacagagcaacaaggtcttgtatggttgcaacagcagcgtcaggaaaaaatcgcagatttacaaaccgcacttcgtattaattataatcgtccattgctggcattggattgtttggaaaaggggttattggaacaacgaacgacatttttacgtcagttttggttgttttatattcgacgttctcccttggagttattaccgcactttacgaaagaaaatgttttattacaactggactggatgagtgcatttttacatgatgcactcaaagaaaaattaggtgttcggcaaggttggatcagccaagatttagctcgtggcattttgcaatttaatgaaaagcaaaatgtggaagagttgttaaaagcaattcaaattatccaaaaaatgcgtttgaatctaacgcaaatcaatggggttaaccaagagttaattttattagagggattgactcgtttggtaaccgatgtatttgaaaggaaagaataggaaaagaaatgtttattgtggatagtcattgtcatcttgatgccttggattatgaaaacttacatacagatattgccgatgtggtggataaagcaaaacagcgtgatgttaaacatttattggcagtaggggtaactttgaatcgttttgagcaggcttatgcacaattagccttatttaaggaagtttccctcgcttgtggtgttcatcctttggatttggcggaagaaccttttgattatcagcgtttattgaggttggcacaagatgaaaaggtagttgcgataggcgaaaccggattggattattattacagcattgaaaataaagctttgcagcaatctgtttttgcacaacaaatagagattgcaaatcaactgagtaagcccgtgattgtacacactcgatccgcccgagacgataccattgccattttgcgagaaaataatgcacaaaagtgcggtggtgttttacattgtttcacagaaaattggggaatagcaaaacaagcacttgatttagggttttatatttcgatttcaggtattattacctttaaaaatgcacaagagttacgtgatgtagtacgtcaagtaccattagagcgtttgttagtggaaactgatagcccttatttagcaccagtcccgtatcgaggtaaacaaaatcagccggcttatacacgtgaagtttgtgaatatgttgcaacattgaagggattatcagcggaagactttgcacaaattactacgcaaaattttgagcgtttatttaagattaatgtacaataaagcaacaatttacagggggagttatttatgagaaaaatatttaaaaaggtagtgttggggttactattcttattccatgtttttttattttctgtggtgcattatgttacgccacattatgatgttaccaaagttaccggtgtagaagttaagagagttgataaagatggacctattactaaagctaatccggctgacggtccgactcgtgatgtgtattatatttacacgcaaaaaccgaatgaggaaaacgtgatggtgtatcgtaatgaagatacacgttggagttttccattttattttaaattcggttccgccgatttacaggcaaaagcccaaagtttttcagtggatcataagttagtggaaattaagtattatggttggcgtttggttatgtttgatgaattccgtaatgcagtgtcagtcaaagaggtgagtgcggatacagaagcttctcattccattttagcttatgttttttacgcatttttattgattacgttatttttctctatccaatttgtgcgtggttggtttgatagtgaagattaactttttggtttgatatgcttctattctcatcagaagctactttgttaggcattgaatattatgagtttattacaggcaatattagtcattattggcttaattattattagtgcggtcgtttcttccgctgaaatttcgttagccggttcacgtaaattgaaattgcaaatgttagcgaatgagggtgataaacgagctgtgcaagtattaaaattacaagagcaaccgggacgttttatcacagttgtccaaattggactaaacatggtggcaatttttggagggattgtgggtgaaagtgccattcgcccttttttacaggagattttaagtgcttatacgcaatctttttgggtagaaagtgcggcttcttggctggcttttattattgtcactgtttcttttgttctcttcgctgatttaatgcccaaacgtttagcgatgacaagtccggaaaaagtagcattgtcaacagtaggaataatgtctttttgcattgttatttttaaaccagtggtcttaatttttgatactattgcgaacggaatttttcgcttattgggaatttctaccatgcgggaagagagtatgacgccagcggatattgtcgcaattgtagatgccggtgctgaagcaggtgtattaaaagcacaagagcattatctgattgaaaatatttttgaaatgcaagagcgtacagttacgtcaactatgacgactcgtgaaaatattgtgtttttagaccgctcttttgagcgtgagcaagtcatcaccacaattaaaaataatccacattcaaaactacttatttgtgatcatggcttagataaaattttgggctatgtggaaagtcataatttattaactttatatttgcaagaacaacaagtttctttaaccgagcctagaattttacgaaaggcattatttattcctgatacgctttccctatatgaagtattggagttgttcaagtcttctggtgaagattttgctgttattgtaaatgaatatgctctcgtagtgggaattgtgactttaaatgatgtaatgagtattgtaatgggcgaattagtttctaatgaggaagaacaaattgttcgccgtgatgaaacatcttggttgattgatggtgcaactcccttagaagatgtagcacgggcattggaaattaatgagtttccggatgaagaaaattacgaaaccatagggggatttatgatgtatatgctacgtaaaattccgaaaaagacagatttcgtattatatgatagatataaatttgagattattgataccgagaattttaagattgatcaattgatggtatcgctaagaaaggatatttagacaagattcaaaagagagtaaaccacatcttcgctttctttagatattatcagtcaaatgcaattaatgggatttttcttataaaaatagaaggttatgtaaaagagataaaaagcaatccgaagattgcttttttgttccgcttattgagcaagtgcacgttttaattttaggatagtcgccttccctttatcttcatcgacttgtttaagattggctccgccaacaaatgcaccgggtttaatatattggcgaataaaataattttttccgccatctgtcgtaatatcaaggtgattatcactaaactctgattctgttgagagcctatgattacctgggattacacgcttgtaaaaatatgttttgggtgcggattcaccaataagtttgccatcgatataaagattcttcttcaacgcagctccaaatattgaatcacgataaatataaatccctgattcatcctttgatggaagcaaaaactgtttagccaaagcatcattttcaggggtatccatcaccgttctggcacaaccggtaagtcccaaagtgattgccagcaagagagttgaaaaaaatttcatttgatgtctagcccatacgacttagaagtaataacttgcactcaatgacaagctttgtggcttgaagcgaatatcgccttttatattgcggaggaagactttttgatattcaacacccacatcaaatttatccgttacggcatattttacccctacagcagtaccaataccgacaacagagtttccttttatggtgcaactatcacaaattttcttggtattaagatcataaaaatgactatttaaactcactttaagatacggcatgaaattgttactaatgcgatagccttgaagatagccgacactgaaagaaaatttttctttggatagtagttcgttattagaagtgatttttgaaccgccggtacgtaattttacttctgcctgacctacaaaattactgtcaccaaaattaaagccgtaaccaccgaataaaccaaagcctattttgcctgatttttttttggtttcgctttttgctgtgctagaaagcgtaccctcataaccatgttttgaatgatgaacttctccacccataaaaaagccagtgaaagtatcttgtgccattgcaccacttgccatgcaagataataataccgttgcagctatagatatttttttcataaataaatcctcttaataaagattaagttaaatttgaaactattttattgttaagagaaaactaagtcctaagatcttaattttcaaagatatattctacataggtatattatgagtaccatagacaaataagacattattagtctaataagtagaaaaatagtctaaaaagaggaaatgaaaaaattatttacatattgtctgaaagtatttaaacgaaaagagcggtgtaaattttaaaaattcgtaccgctctttttctatatcagttacttaaaaagaatattcatgtttctgcgatgttgcagccggtattttctattaagaattataatttaggctcaccaattggtaatatggttttaccaaaactttcattgataatatcagcagcagcgagatagaacgctaaaagtgcggtcaataaaccaaagtttccacctagttggctaaagttgtgattaccggtaaaatcgcctacagcaagtaagtagaaggtgatggttaacgctaagaaaatagcctgtaatgcacgagtttttgctaatgtgccgataaacatcatcaatgtgaatgttccccacgccgctaagtaccagcctacaaaagatgatgtgacaccttgtgagaaaaatactttgaataaggcaaaactccaccaaaatgcaccatagctggtaaacgcagtaaaaccgaaagtattaccttttttgtattcaaacataccggcgatcatttgggctgtaccaccaaacgcaaatcccatggctagtactaaacctaaattttcaccgctgaacataccgttattgattaaacttaataaccaagttgttaatgcaaacccacataagcccaatggtgccggattcgctaagttatcttttgttgtcgacattatattttgcccttaaattaatttgataaataaaaaaggcgttattatctatgattttattgaataaataaagattggtatgaaaaacgctaggataagaacaatgaaattgggaaagtagctagaaaattaattattttttgtttttcgctattgttatttagatgtaaaatacgttcagctgagttttaagggtaaaatacgatgagcgtttagtcgccacttagtctgcaaaatgcgaaatgttaaatcacaagcatgtgagtttaaggattggtaagaaatgttatcatcaagttaaacgtcagtttctcgtttttacgcctaaagttgctggagcacatcattggacacaggtaagctcgacattagaggggagttagaataaaacggatttcgttttctaacagaagaaagtaattgtttttaaaaggaaaatttgttgaatactcaatctaagcaaaacgctagttttgtttttattttaaccttaggcattttatcaatgttacctccacttggagtggatatgtatttgccggcatttttaaatattgcacaagatttgaaagtaagcccagagcaagtgcaacatactttgactttttttacttatggtttggcggcggggcaattattttgggggcctgtgggagatagttacggacgtaaaccggttattttattaggtgtgattgttgcgactattacagcatttattttaaccagtattaataatattcaaaatttcaccgcacttcgttttattcaaggcttttttggtgcggcacctgtggttttatccggtgcactattacgagatttgtttagcaaaaatgagctttctcgaatgctatcgatgattactttagtgtttatgattgctccattactcgctccaattattggcggtaatttgatgcgttttttccattggcatgcaattttttatgttatctcggcaatgggaatgctaagtgcggtattggttttttatgttattccggaaactcataaaaaagaaaatcgcattcctctcagattgaatattatcgcacgtaactttttttctctgtggaaacagaaagaagtactgggttatatgtttatgtctgcttttggttttggcgggttatttgcttttgtgacagcaggttcaatcgtttatatcggactttatggtatagccgttgaaaattttggttatttctttatgttaaatattggggttatgattattgcctcttttatgaatgggcgattggtgtttaaagtgggtgctgaacgtatgctacaggttggcttgatggtgcaatttatcgcaggtctttggttagcattcgttgcgttttttgatttaggtttttggtctatggcaattggtgttgctttttttgtagggcaaaatccattaatcagttcgaatgccatgacatctattttagagaaatttccaactatggcaggaacatcgaattctatggttggaagtgtgcgtttcggtatgggggcaatagtggggacaattgttgctttatttgaaatgaaaacggcagcaccaatgcttttaacaatgacgatttgttctttgcttgcggtaagttgctattattttttaacttaccgtcatttaaaaaaataaaggaagatcatggcattgcaaccttgccctgagtgtcggcgtaaaatcagtgagtgtgcgataagttgtccacattgtggtttttcgttgcaagaagaaaattgggtgctatatcgtgaaaaactaaaaaaacattgtcagtataatcaggaaattaatcgaacaagtgttagaatccatttattttggttggtagtattttctatagtaattgggatagcaggctggttaagtaattagtcgttaaaagatattcaagcccctgtaataaggggcttttttgtatggtttaactttttgttttcattgctggaaataaaatcacatcacgaattgagttagcgttggcaaataacatcgctagacgatcaattcctaaaccctcaccagccgttggtggcaatccatgctcaagtgcggtaacaaaatcttcatctttaaacatagcttcatcgtcaccagcttcttttgctgcaacctgtgcctcaaaacgctcattttgatcttctgcatcatttaattctgagaaaccgttaccgatctcacgtcctccgataaataattcaaagcggtctgttacgtcaggattttcatcattgcggcgtgctaaaggggagatttctgccggatgagccattaagaaagttggttgaattaaatgatgttcagcaacttcttcaaaaattgcattgactaagctacctagcccccatgatttttgtacttcgatacccaatttttgtgctactgcgacagcacgatcgaaatcgtataaatcttctttcacaataccttgctcggcaccgtattttaagattgcctcgtgcatggtaatacgttcaaacggtttgccgaaatcgaattttaaatcgccgtaaggaacaatggtcgtacctaaaatatctagtgctaatttgcgtaaaagttcttctgtattgtccattaaatcgtggtaatccgcataggcttggtagtattccaacatagtaaattcagggttatggcgaatagaaacaccttcattgcggaagttacgatttaactcgaatacacgttcaaaaccgccaactaccaaacgttttaaataaagttcaggtgcaatacgtaaatacatatccacatctaacgcattgtgatgagtaataaatggacgtgcagatgcaccgccaggaataatttgtaacattggcgtttcgacttccataaatcccttggaaatgaaatattctcgaatacctgcgattactttagatcgaataataaaagtgcggcgtgaatcttcattagcaattaaatctaaatagcgttgacggtagcgagtttcttgatcgctcagtccatgaaatttattaggaagtgggcgtaatgctttagttaataattgaacttccgttgcacgtattgtcaactcattggttttagttttaaataaagtaccttttacaccaacaatatcccctaaatcccaattgcccacatcatcagtataaacaccttcagctaggttatcacgagcaacataaagttgaatttttccgctcatgtcttgcaatgtgataaaggttgctttacccatgacacgacgagtcataatacgccccgccacttttacttcaattccctgtgtttttaagctctcactttcaatttcatcatattgtgtatgtaagtcctgtgctaaagcattgcgacggaatgtatttggaaaggcgttgccttttgctcttaacgcagctaatttttcacgacgaaccaacatttcgccattgagatccaattcttgaattatttctgtcattatgtactcctcttggaaagtcacgtgtagaataaatttgtcatttgaataaaatattgtgttttttgaccgctctttatagtccggcttttaagctggcttcaataaaacgatccaaatcgccgtccaatacagcttgagtattgcgattttcaatacctgttcgcaaatctttaatacgggaatcatccagcacataggagcggatttgactaccccagccgatatcagatttactgtcttccatggcttgtttatcagcattttttttcattatttccatttcgtacagttttgcttttagctgcttcatggcttgatctttattctgatgttgagatcgtccattttggcattgcaccacaataccgctaggaatatgagtaatacgcaccgcactttctgttttattaacgtgttgtccgccggcacctgatgcacgataaacatcaatacgtaaatctgcaggattgatttctatttcaatatcatcatcaatttcaggataaacgaaggcagcggcgaaagaagtatggcgacgattattggaatcaaatggacttttacgtactaatcgatgaatacctgtttctgttcttaaccaaccgaaagcatattcgcctgcaatacgaatagtggcagatttcaagcctgcaacatcgccactggaaacctcaactaattcggttttaaagcccttgctttctgcccaacgtaaatacatacgcaatagcatttctgtccaatcctgagcttctgttccgccggagcctgcttgtaggtcaacataacaatcacagttatcatgttgtccgctgaacatacgacggaactcaagggcggcaagttttttttccaattcttccgcttctgcgacagcttcattaaacgttgtttcatcttccgcttctacagacagttccagtaagccatcgacatcttccaaaccttgctcaagggtttttattgtattaacaacaatttctaaattagaccgctctttgcctaatgcttgagctttttccggctcattccaaatatccggttgttcaagttctgcatttacttcttctaaacgttcaacttttgtatcaaagtcaaagataccccctaagcatatttgtacgctcagtgagatcgattaatttattttttatcggattaatttcaaacatagcttttcccaatgataacaagtgctgaattataagctattttgctgatgttgggtagttgcagattagattgttcaaaggatttatgttagaatttcgtccgttttttactgaaaattaggaacttaaaatgaaaaaatttttaatggtaagtttagccatgttgatgtcaacttttgtaaaggcagataataatgtcacaattcgcaaaaatttacaaaaattaggtatgactgatgtagaaattatggagtctcccattaaaaatataaagagtgttttgacccgtgaaggtactctgtatgtttcggaagatggtaaatatgttttacatggtgctttgtatgaaattactgacaaaggtattgtgaatttaacgacaaagtctttattggtaaaactgaataacttaaaaaatgagatgatagtttatccagcgaagaaggaaaaatatgttattaccgtattcatggacattacttgccattattgtcatttattacatcaaaaaattaaagaatataatgagttaggtattactgttcgctatttagcctttccacgtgctggtctacatagcaatacagcaaagcaaatggaagcaatttggcagtctaaagatcctgttttcgccttagatgaggcagagaaaggtaatttacctaaggaattgaaaacgccaaatatgatccaaaaacattatgagcttggcattcagtttggcgtaagcggtacgccaagtattataactgaaagcggcgaagtgattggtggttatctagagcctaaaaaattattgcaagcgttagaagatattcgtgaataagtttattaaacgacgtgatgttgcgacagatgttcaagtttgtgaacatcctttattggaccgaatttatcgtgcacgccaaattaagaatccgcaacaattagaccgcactttgaaatctatgttggcacctgatttgctacatggtattggaagtgcggtggatttattggtaacagcgagagaaaaacaacaaaagattgttattgtcggtgattttgatgttgacggagcaaccagcacagcacttattgttttggctcttcgtcaacttgggttcacagatgtagattatttagtacctaatcgctttgagcaaggttacggtttaagcgtggaagtagctaaattagcattagaaaaaaatgttgagttattgattacagtagataatggggtatcttcttttgatggtgttgtgtttttaaaaaatgcgggagtgcaagtgttgattacagatcaccacttaccgccggaaatattgcctcctgcccatgctattgttaatccaaatcttacacaatgtaattttccttcaaaatttcttgctggtgtcggtgtcgctttttatgtcatgctggcattgcgtgcaaaattacgtgatttagggatttttactacgcaaacccaaccgaattttacagcgttattagatttagttgcccttggtacaatttccgatgtagtaccgcttgatcaaaataatcgtattttagcttatcaaggtttagccagaattcgagctgagcgttgtcgtcccggtattcgtgctttggcggaaattgcaaatcgtaatatgagtcgattgaccgcttccgatttaggcttttctattggtccaagattgaatgctgccgggcgtttggacaatatgtctgttggtgtggagttattattggccgatgatatgcaacatgctcgtcaattagcttttgaattagatagtttgaatcaggctcgtaaagaaattgagcaaggtatgaaacaggaagcgttagaaatttgtcggaatttgaccgcactttctaagcaattaccgctgggcatcgtactatatcaggttgattggcatcaaggtgtactcggtattttggcttctcgaattaaagataaatttcatcgaccgaccattgcgtttgctcaggatcaagtcggaattttaaaaggttcagcacgatctattgaaggtttacatatgcgtgatgtgttagagcgtattcattctcgctatccggatatgattttaaaatttggtggtcatgcgatggctgctggtttgagtattcgtgaggaattgtttacacaatttcaacaagcctttattcaaactgtgactgaatggttaaaagaagaacaattacaaggtattatttggactgatggtcaattagcacccgcgtttttaaatttggagacagcggaattactgcgtcaagcaggtccttgggggcaaggttttccagagccgtgttttgatggtgaatttacaattttacgccagagtattgtgggtgaaaaacatttaaaaatgcttgttgagcctaaacaaggaggtccgctgttggatgctattgcatttaatattgataaggattactaccctgatttttcgataaaacatgcaagaatagcttataaattagatagtaatgagtttcgtggaaatcgtcatgttcagttgttggtagattatattgaacctttagatcattaaatttatttttcggcactggtacataataatgttttagggacaataaaaatgacagaagaatatggcgtatttacttatccctatgtcattattaatggtaaatatgttttgacagcaagtactttatataacgatgattatagtgttgcagtgcttgattttttaattcatcaaattcaagtggagagcaggaaatgaaagtaggtattgttggtgcgatggcacaagaagttgagattttagcgagtttaattgagaataaaaacgtagttcatattgccggctgtacaatttatcaaggaaacattcaagataaggaggttgccttattacaatccggtattggaaaagttgcagcggcaatgggaactacactattattgcaaatgtttaagcctgatattgttattaatacaggatctgccggcggcgtatcctccggattaaaagtgggtgatgttgttgtgtctactcaaactgtttatcatgatgctgatgtgacagcctttggctatgctaaaggtcaactgcctgcttgtcctccagcttttatttctgatccaaaactgaccgcacttgttgcaaatgttgcaaagcaacaaggcattaatctgacttccggtttaatttgctccggtgacagttttattaatagtgtagaaaaattagcttggataaaagcaaattttccagaagttgttgctattgaaatggaggcaacagctattgctcaggtatgtcataaattcaatattccgtttgttgtcatacgggcgatttctgatgtcggagacggtgaagcaagcatgtcttttgaagagtttttgcctttagcggctaaacagtcttcctctatggttctaaatatattacaaagtttgtagggaattgatttattataaatatcaacttgataaataaagaaaaaatctccaaattgatctgcacyccmaaagttggactaaacmryyaacwagttarggtrcagattttttatgactaaatataaycaatcttttaamcaacaagtgatygaattttatcttcaaaatggggaaaatcgttcactgacccgtcaacattttcagcttgagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggaatgttacttcggcaagcgtttgagacttttgaacaacttgaacagacgattcacaactacattcattactacaataatgagcgtattcaagtgaaattaaaaggactaaaccccgtggaatacagaactcagtccttgaattaaatcagtctaacttttttgggtcagannnnnnnggagattttttgttttggattattttgagcttggaatgctgaaacgcttgttgaaacgttctacacgaccgccggtatcaacaacacgttgtttaccagtatagaaaggatggcagttgctacatacgtccaagttcaaatttttacccactgttgaacgagttttaattacgttaccgcaagagcaagtcgcagtaatttctttatattcagggtgaataccttgtttcatagaaaacctcttaaaaatcactccgctctccaaaaccgaatttggcaccgagtgctgttaatattacgccatctaaaggcaatttagtaagatggcagattataccgaaaaaatgggctttttcaagttatctgtataaaaaaccgcactttatccttgcattttaaagtgcggtataatttgcaacaattttttacattgctgtccaaagtaaaatggcaagcaactgaggcgacataatacgcaggaacatagaaagcggataaacagtagcgtaagataatgcagctataccgctatcttctttaattgcattggcaaaagccagtgcgggaggatcagtcattgaacctgcaagcaaaccgcataagctgagatagtttaatttcatgtataagcgagcaataatgccggtgatcattaatggaataaaggtaatgaacataccatatcccatccattcaagtccttgaccattaaccagtgtgtcaacaaatccgcctccggattttagtccaacaacagctaggaataaaacgataccaatttcacgtagtgctaagtttgcactgggcggcataaaccaatagagtttaccgacactaccaatacgagcaaggattagtgcgacaactaatggacctccggctaaacctaattttaatgctacagggaatcctggaatgtagaatggaattgagcctaatagcacgcctaatccaattccgataaataccggtaacatttgcacttgttgtagtttttgttgtgcattgccaataattgaggttgcatcaccaattgtatcggatcgccctacaatatgtagcacatcgccaaattgtaatgcggtgttggctgttggaactaactctacgccggcacgatttaaacgtgaaatcacaacgccatattttttatgaattcctaagtgttttatgcgtttaccaagcactttttcattggtaacaacaatacgttcagagcgaagatctcctgctaaatgagtcataggcatatcaatttcctcacctatcaccaatttcatttttttcaaagcattgatttcaccaactaaatgtaatacgtcatcaattgctattatggtatctgcacttggtacactaatattttcttgtcgttttaaacgagaacaaaccacatctttattgtcaaagccgggaatatcaattaatcgtaaaccacttaaatttggattggtcactttaacatttactgttgttaagctttctttatcctgtccgctggctttttggaattgtttctcttcttcttcaaccttaattttaaaaaataaacgaattaaccacatgctaagtaaaatgccgcaaatcccgaaaggataagccatagcgtacgccatacccattgtgctgttagcattttctatgcctagttcagtgagaatttgttgacccgcacccaaggatggcgtattagtgaccgcaccggagtagataccgagaataatatcaagatcaacattaacaactttatataggacaaaaacacttactgcaccgagaacaacaattaatgttgctaagccgttaagttttaaaccagcagagagtagagaggcaaaaaatcccggaccgacttgaatgccaatggtataaacaaatagaattaacccaaattcttggataaagtgtagagtgtgtgcatctaattttaatccattttggttcataaaatgagcgacaataattccaccgaataatactcccccgatgcctaaaccgactccgcgtattttccaatgccctatccataaaccaataacggcaacaagggctaggatacaaattgtgatagcaatatcactcataccgacctcttttaaagttaaatataaaaaatagctactcgaattatatcaagctcaattcaaagaaacgataaaaatctaaaaaatgtaggatttatcacatttttcttgattaagttatggtttttattaacaatatttgaaaaaaattaaattttatttaatccctttattataagaggcgttgagaatacaaaatgaattggtcggaagaactttttacatcgttactttggatagtgaaaagcttagttatagcaagcttggttttctctttaattttatattttttgataaaaatgacccgatggggacatcaattttggctattagcgaaaagttatttatcaccacgtcgtagccttatacctttgtgttatttttgggtaatcgttttttttgatttattagccgtgcggttagatattttattttctggttggtataagtccatgtatgatgccttacaagaaatgaatgtagctagattttggcagcaaatgattgttttctctcttttagctgcggttcatatatgtaattttttattcacttactatatttctcaggatttcaaaattaagtggagaacttggcttaataatgaaatgttagataaatggtctgaaaatcaggcttattataaaacccagtgccttgctcatcaattggataatccggatcaacgtattcaacaagatgttgatgcctatgtttctaattcattaaactttgctacaggtgttatttcttttacagtgtctttagctgcatttaccgtgattctttggaatttgtcaggcccaatggtaattatgggctacgaaattccacatatgatggtattcttagtgtttatttatgtattggtgagcagtgtaattgcttttagaatcgggcgtccattgattcaattgaattttgctcatgagcgtttaaatgcaaactatcgttattcacttattcgtttgaaagaatacgcagaaagcatagcgttttatcgaggagagaatatagaaaaatcgatactattacgtcaatttgaaaaagtcattggtaatttgtggcaaataattcaccgcactttgaaattatttggctttaacttagtggtttcacaggtatcagtcatttttccatttattattcaggcaacccgttatttttccggacagattaaattgggggatttagtacaaacctcacaggcttttagcaaggttcagtcagcattatcgttttatcgaaactcctatgatgattttgccgcctatcgagcagttctggatcgtctaacaggtttccatagtgctattgaagcagctaatcagccatcaaaaacacaaattaaacctcatatgtcagcggttatttttgagaatttaaatattaatacaccggaaggaaatactctcattgagaagctgaacttaacaattgagcaaggagtttctttattgattaaaggtaaatcgggtgtagggaaaacaactttattgcgtacagcagcaggtttatggccgtattcagaagggcagattttttgtccacaacaaacattgtttctagcacaaaaaacctatttaccacaggggtgcttaattgatgctctttattatcctgaaccagttccagccgacattgacgcagacaatatcagtaacattttgcaaaaagtgcatttgtctcatctggttgacaaattggatgtagaaaatgattggacgagagtactatctttaggggaacagcaacgtgtagcttgtgccagagtattgttgcataagcctaaagttgttttcttagatgaggctacatcaagcatggatgaagggcttgaagatgcgatgtatcgcttattattaactgaattacctagtacaactttaatcagcgtgggacatcgttcaactttgcataagtatcatcaattacacttgcagatcaatagtgataaaagttgggacatgatgaaacatacagaaacattttagcgtaaaacatatttgttaatttgctgaatgaaatgtatccattgatgttaagtcgatggatttttttatgggttaaatttgatatagatcaaataaaattgatttttatttgcaaagtattctcaataaaaatgagtttttttactagaaaaattaatgattaagcaggtttttcttacaaaatttatgtaaataatgcacaatatatagtggttgagtttttaaaagtaacaatatatagtgatttgacttttattaaacgcaacatataggtttatgtaaaaatgggttcattcttcgttattaaacgtgatggttcacgtgcagaatttgaaatacaaagaattattaatgctattaaaaaagctgcaagtgcggtcaatatccaagatgaaatgttctgtcataaaattggacaactggtctgtgataatatttttgctcactaccaaaaagaaattgatattagccacattcaggagattgttgaaaatcatctgatggctagcaagtatccacaagttgcacgagcttatattgaatatcgtcatgagcgtgatttagctagagagaaacgtagtaatttgactaaagaaatcgaaggattaattgagcaaagtaatgtggaattgttaaatgagaatgccaataaagattcgaaagtcattccaactcagcgtgatttattggcgggtattgtcgctaaacattatgctaaacgttatattctgccaaaagatgtcgttgattcccatgaaaaaggcgaaattcattatcatgatttagattatgcaccattctttcctatgtttaactgcatgctggtcgatttaaaaggtatgctgacgaaaggatttaaaatggggaatgcggacattgagccgccaaaatctattggtactgcgactgcggttaccgcacaaattatcgctcaagtagcaagtcatatttatgggggcaccacggttaatcgtattgatgaagtacttgcaccttatgtgcaactcagctatgaaaaacacttgaaaacagctgcactttggcaaattccagatcccaaagcttatgccgacagtttaattcaaaaagaatgttttgatgcttttcaatcgttggaatatgaagtcaacaccctgcatactgccaatggacaaacgccatttgttacttttgggtttggtttggggatcagttggcaagagcggttgattcagaaagctattttgcaaaaccgaattcgtggattggggaaaaatcataaaacacctgtttttcctaagttggtttttacaattaaaaaaggggtcaatcaaaattcaggagatccgaattatgatattaaacagctcgctttagaatgtgcttcaaaacgcatgtatccggatattctcaattatgatcaagttgtgaaagtaacaggttcatttaaagcaccaatgggatgccgtagttttcttggtgcttatgaagaaaataacgaattggtccatgatggacggaataatttgggtgtagttagcctaaatttgccacgtattgcattggaagcgaaaggcgatgagcagcgattctatacattgcttgaagcaaggttggatcttgctaaaaaagcattgatgacacgtattgcccgtttggaaaatacaaaagcacgagttgcaccgattttatatatggaaggtgcttgcggtattcgtttaaaagcagatgataatgtggcacaaatttttaagaacggtagagcatcaatttcgcttggttatattggtattcatgaaactattaatgcgttatttggcggtaaacacatttatgatgatgcaaaattacgtgaaaagggcattgaaattgttagttttttaagcgaaaaagtaaaacattggaaagcggaaaccggttatgcttttagtttatattcaacaccgagtgaaaatttatgtgatcgtttttgtcgtttagataccaaacagtttggcgttgttgagggcgttacggacaaagggtattacaccaacagctatcatttagatgttgagaaaaaggtcaatccttacgataaattggattttgagatgccttatcctcatttggcaagtggtggatttatttgctatggtgaatatccaaatattcagcataatttgaaagcacttgaagatgtttgggactattcttatgaacgagttccttattatggtactaatacaccgattgatgaatgctatgaatgtggttttacaggagagtttagttgtacaagcaaagggtttacttgccctaagtgcggtaatcatgatagtgaaaaagtctctgtaacccgtcgagtatgcggttatttaggaagcccggatgcacgtccgtttaatgctggaaaacaagaagaggttaaacgccgtgttaaacatttataaaaatcatcgctctttatgaattatctgcaatattatccgattgatgttgtaaatggcgaaggcacaagatgtactttgtttgtcagtggttgctcccatgcttgcaaagggtgttacaaccaaaagagttggtcatttagggctggagtattatttgatcgagagatggaagatcaaattattcgagatctacaggatagacgcattcgtcgacaaggattgagtttaacaggcggtgatcctttacatcctcgaaatattaccgcacttttgccttttgtgcagagagtaaaaaaggaatgtcctgataaagatatttggctatggacaggttatttattagcggagcttgatgaattgcaacggaaaatgttgccttacattgatgtgttaattgatggtaagtttgagcaagaaaaagccgatccaagtttgatttggcgaggatccgcaaatcaagtgatttatcgctttaatatttagcttttatacatattcttaaataagctcattcatatgtatggtgtggtgtattcaaattctatattgaatttgcataaccaatttcaacttaggtatttgtaacgatatagaatatatcagcaaattgaatattataaaaaaaccgctcataaagagcggtttttgtgcgaaggttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagctacattacatagctttctcttaattgagttaaatccttgatatataaggacttaaccccagtaagcacaacacttgtcgcacttagcctttgtagttatgtacatgagcaactaaatctaagactttatttgagtagccggtttcattatcataccaagaaactaatttaacgaaagtatcagttaatgcaatacctgctgccgcatcgaatacagaagtcaagctacaaccgttgaaatcagtagaaactacagcgtcttcagtataacctaatacacctttcatttcattttcagaagcacgtttgatttctgcacagatttctgcataagttgccggtttttccaagtttacagttaaatcaacgacggaaacgtttggtgtaggaacacggaatgccatacctgttaatttaccattcaatgcagggataactttaccaacagcttttgccgcacctgttgaagaagggataatattttgtgccgcaccacgacctccacgccagtcttttgcagaagggccatcaacagttttttgggttgctgttgttgcatgaactgttgtcattaaaccgtctttgataccgaatttgtcattgataactttagctaacggtgctaaacagtttgttgtacaagacgcattagaaacaatgtcttgaccggcatacgcatcaaagtttacgccgttaacaaacattggtgttgcatctttagatggaccggttaaaacaacttttttcgcacctgcggtaatatgtttacgagctgttgcatcatctaagaataaacctgtcgcttcaacagcaacatcaacaccgagctcattccattttaaattagcaggatcacgctctgatgtaacacgaatcgctttaccattaaccactaagtttccatctttgacttcaactgtaccatcaaaacgaccatgagttgaatcatatttaagcatataagccatatattcaacatcaattagatcgttaataccaactacctcaatgtcatcacgagtttgtgctgcacgaaatacgatacgaccgatacgaccgaaaccattaataccaattttaattgtcataatattttcacctataatattttaagttaaacgaaactcgatgctttacagaagtgcttagtctttctagttttcacgctggggtagattatagcataaattcttctttgattatagtgtctctagagtaaatccggcatatatagattttttatgatccacgtcaaagttgataatgtttgtaccacattgattttttagtgtagtatgtgcggagatttatgtttcatcgttaagcggaaaatgacttttcatatggaaataggaagaatatcatgttaaccaaccaaccaaccaaccaaccaaccaaccaaccaaccaaccaaccaaccaaccaaccaaccaaccaaccaaccaaccaaccaaccaaccaaccaaccaaatgaacgtctattttccatagtaaaggaagtttttccgaaaagtcatagcataaatttttgtcttttagggggaatgacaaataagaattatctccttcatgtggataatgaaaaatatgtattgcgtctgccaggggtaatgacatcgaatttgatttcaaggcattatgaaatgaataatagtatattgatgtctcaggcagaatttaatgttgaaacaatttattttaatgctgataatggtattaaaataacgaagtttttagatggggggattaattttaaccataaaaatattcatcaatatgaatatttatctctcattgcaaaagaattatataaattacatcattcagatattcaatttaataatgcatttaatgtatttgaaacttttcaacaatattttgacttattaaaagataagaatagatttttttgttttaataaaaatattccattgatatacgaattttttattaaaatttcaaagaataattctttttataacatcaaatgtccttgccataatgaccttgttcctgagaatattttactgaaaaacaataaattattttttattgattgggaatattcaggaatgaatgctccgttattcgatgtggcggctttttttcttgagtcgagaataccagaagaaaaacaaaaatatttccttgctcattatgatcgttgcctggattttgagaagtctcgcatagaaatactatttcatcaatttacccaagatgttttatggtttttatggactttgataaaagaagaaaataatgaaacatttgaaaattatgcctcaataagaataaatcgtgcttatgaactgatgaaggatttggtgaaaaatgggtttatttagtgaagatcaacgattagttcatatcggttatttttgtggattattatccggtttattttgggcaatatcaggaatttcttacgaaaaattatatatagatttcccaatgctgaatgcgtttgcattaaatattattatattaagtattgctgagattactttgctgttaatggcttatggttatttgataaaaagaaaattattaccgcactttaataaggtttctttgttagcgattttgggaggttgtttgggtggtcctgttgggatgatttgctatttacagtccttacaatatgttggagtgagttatgcggcgaccatttcaatttgttatccaattatagcatctattttatccatcaagtttttagctgtgaaagcatcaagaagaacactattttcttttgtttttattgtcttattattaatgcctgtcatgtatcaaggtgaaaattcagaaatcaggattttaggcattatttttgctttttcttgtgcattatgttgggcacttgaaattgtgatttccagttatgtcatgcagcactatccatccgatcaagtttatttatttagacaaataggatcatcttcaggatattttcttattattcttttcatgtttttttatggaacttatgacaatttaattgattttaatttttttaaggatgtaaatctatggaaattggagtggatagtcattatttcctcaggattttcttattttctatattataaatcaattgcaattttgaatccaattagagcaatggcattaaatattacatatagtctttgggcgattgtattaagtgcggttcttttatcaaaggaaattagtatctttctgcttatgattggaataattgtattgatgaatatttttattgtggcgaaaggagaagaaaaatgaatgccattattttagcggcagggttaggaagtcgttttagagagattacgcagaagaagcataaggctttacttccgttacctaatggaattcctaatattgagcaaacaattatttatttaaagcaagcaggtattcatgagattcatattgtaacaggttattttgctgagcagtttgattttttaagtggtaaatacggggttaatcttatttataataagttttataaaaagtacaataatatctattcttttcattgtgctattgagcatttcggagaaagttttgttattgacagcgatgtgacgctttttagcaatatttttaatgataaattaaaacgaagtcaatattttttaattcaacgaaataaaagtcataataaagaatggattccgattgtgaaagataaccgcgttattgatattattattgatagtttggaattgcctagcttactgggtgtctctttttggtcaaatcatgatgcggtcaaaataaaatcatttctggctgattatgtgaataatgaaaatttattacttgattcatcattgtattgggataatattccaatggaaaatcttaaagaattggatattggtgtaaagcttttgaatataaaggaagcttatgaaatagataatttatccgagtatgaatttatatttcatcatttaaaaggtaaatagtatgaaaaaattatcgctgagagaacttcaattggtatcattagatattttgaaatattttgatcaattatgtgctaaaaatgatattcaatattccttaggcggaggaacattaatcggtgcagtaagacacaaaggatttattccatgggatgatgatattgatgtctatatgcagcgtgatcagtatgaaaaattcgttaatgtttggaaaagtgagacgcatgctcaatatgaattgtctttagcggaggatattcatggtatgtttccgggtgagatgacaaaaatttttgataaaaatactttaatcatagatacgaaaggaagaaaaagtggcatatttatagatatttttatttatgatggtgtgccaaatgacccggcggtgatttataaagtgatgaagaaacatcgtcgccttaaattgaggttttcatcttgtcgtaagagatggtataaagctaataatgagagtttaattcagtctatattttttagattatcccagtatttatttaataagatgatgttaaatttaaaacaatttcaagacaaatatcctattgataaggctgaatatataggacttgttttatcagattacggtggctagaagaagtcttatatgcccaaaaaatattttaactccgttgtttatttggattttgaagagagtaagtttcctgttatgaacggttatcatgaacatttgaccatgtattatggtgattatatggaactgcctcctgttagtgaacagaaacctcaacacacgattgaagcttatatattagattaggcaatctatttcttttttattaaaaatcagcaaaagagcggtcattttgctgatttttttttgatttatcggcataataggtgctataaaaattttatgggagtcattatgtgtaggggaaatttatatattatttctgccccaagtggagcagggaaatcttctttgatttcagcattattggaacgggataaaaacgatagtatgacggtgtccatatcacatacaacaagatccccaagaccgggtgaaattgatggggtgcattatcactttgtttcacatgaaaaatttgaacagcttattttagaaaactcatttttagaatatgcgaaagtattcggtgggaattattatggtacgtcattactgaatattgagaaaaatttagcggcaggtatagatgtattcttggatattgattggcagggagcaagacaaattcgagaaaaacgtcctgatgttaaaagtatttttattttgcctccttctatttctgccttagagaagcgtttgattgggcgtggtcaagatagtcaagacattattgcaaagagaatggaaaaggcagcggatgaaatctcccattatgatgaatatgattatgtcattattaatgctgattttgatcaagcattagtagatttagaacatattttgcgagctgaacgattgactgtaaattatcaaaaaacgcaaaatgcggctttaattcatcaattactagtaaaataattttggttttagtatcatgagagcgttttttgtgaatatattaatggagaaattatggctcgagtaacagtacaagatgcggtagaaaaagtaggtaatcgttttgatttaattttaactgcggctcgccgtgcgagagaattgcaattacataagcgtgaacctttagtgccggaagataatgataaaccgacagtcattgcgttgcgtgaaattgagaaaggattaattaataacgatattatgaacgctcatgagcgtcgtgaggcattagaacaagaaactgctgaattgaatacaatatcgctgttatatcaaaataattaagtaaagtgcagttcttttttgtaaactttatcaagtacatttcaatcttttttgcatattaatcaatagtcaggtgtcttttgtatttatttgagagtttagagaaaattatcagaggatatttgtctccgtcacaaattgagttagttcggcatgcttttgttattgcaagagatgctcacgaaggacaagcgagggctagtggcgaaccttatattactcatccggttgccgttgcttctattattgcagaaatgcatttggatcatgaagcagtggttgcagcgttattgcatgatgtaattgaggatacgccttatactgaagagcaattaaaagaagagtttggtgcgagtgttgctgaaattgtggagggggtttcgaaattagataaattgaaatttcgtacacgtaaagaagcggaagtagagaattttcgcaaaatgattttggcaatgacaaaggatattcgtgtcgtgttgattaagctagctgaccgtactcataatatgcgtacactgggtgctttaagaccggagaaacgccgtcggattgcgaaagaagccctagaaatttatgctcctttagctcatcgtttagggatagagcacattaaaaatgaattagaagatttaggttttgaagcaatgtaccctcaacgttatgcggtattacgaaaagtgattcaaattgctcgtggtaatcgtaaggatatgattgagtgtatcgcttcagatattaaaggacgcttgacggaggtaggcattacggcacgagtatttggtcgtgaaaaacatctttatgctatttaccaaaaaatgcgattgaaagatcagcagtttcattccattatggatatttatgcttttcggacggtggtaaaggatgtggatacttgctatcgagtgcttggtcaaatgcacagtttgtataagccgcgtcagggacgggtgaaagactatattgctgtacctaaagccaatggttatcaatctttgcatacatctatgattggaccacacggtgtacctgttgaagtgcaaattcgtacggaagaaatggatcgaatggcggaaatgggtgtggcagcacattgggcatataagcaatcaggacgaaatgacagtacaacggcacaaattcgagctcagcgttggttgcgaagtcttgtggaattacagcaaagtgttggtaattcttttgagtttattgaaagcgtaaaatcagagttctttcctaaagaaatctatgtatttacccctaaaggacgtattattgagttgcctaaaggtgcaactgcggtcgattttgcttatgcggtacatacagatgttggacatcattgcgtggcagctactgttgatcgtaaaccttatccgctttcctttgcattacaatcaggtcaaatgattgatattagtatcgatggaaattcaaaaccaaattcggggtggctaaattttgttgtgacagcgaaagctcgcacaagtattcgccaagcattgaaatcgttaggtgccgatgatgctgttaatttaggcaaacgccaattactgcaggcacttttacctaaaaaacttagtgatattccaccgcacattgtgcaagaagttttagatgatttgaaattaacgagttttaatgacttgctgatggaaattggtttaggaaatcagattagtggagcaattgcttatcgattggtgggtgagccattgaaaattgatacggatggtaatcctaaaaataatacggaattattgcaaattaagagttctgaaggtttatcaacaacctttgggcaatgttgtcatcctattccgggagatccaattgtggcttatacgagttcaggaaaagggcttgttattcatcataaggattgtgctaatttgaaaaaacgtaaagagaatactgaacattatatgcaggtacaatgggaggatgaagatacctcgattgagtttgaaactgagttgcgtattgaattactaaaccaacagggtgctttacctcatttaatgtcaatgatttcttctttggatagtcgcattcatagcatttggacggaagagcaagacggtcgcctttaccaaattgttattttattaaccgtgaagaacacagaacatttggagcaaattatgcgtaagattaaaagtgttcctggctttttatctgtcaaacgcaacattaataattaatgggtggacaattcttagacgctattccacttacttctttgtcgggtgtcggtgccgcaatagcagaaaaattaggtagaattgggctttttagcctgcaagatcttctgtttcatttgcctattcgttatgaagatcgtacccgtattacccctattattgatcttcgtattgatcaacatgcgacaattgaaggaatagtacaaacttgtgatattcaatttggtcgtcgtccagttcttgtggtgacgctttctgacggtactgccaaaattgccttacgcttttttaattttaatgcaggtatgaaaaatggctttcagcttggagcgagggtgaaagcctttggggaaattaagcgaggtcgatttatggctgaaattcatcaccctgagtatgaaattattcgtgataatagacctcttcagttagcagaaacgctcaccccaatttatgcgacaacggaaggcttgaagcaaaatacattacgaaagttgactgagcaggcattagtgttgctagaaaaaatgccattagcggaattattgcctagagcttttaatccccatgattttagtttaaaacaggccatttacgttttacatcgcccaccaccagatatttctttggaattgttggagcaaggaaaacaccctgcacagttacgtttaatttttgaagaattattagcacataatcttgctatgcaaaaagtgcggtgcggatctcaacatttttcagctttacccttacgttatcaaacagcattgaagcaaaattttcttgatttattgccatatcaaccgacaaatgcacaacaaagagttgttgctgaaattgaatatgatctgggacgttctttcccaatgatgcgtttggtacaaggcgatgttggctccggtaaaactttagttgttgctttagctgcattaattgctattgataacggtaaacaggtagcactcatggcaccgactgaaattttggcagagcaacatactgcaaatttccaacattggtttgaaccgttaggaataaaagtgggttgtttgacaggaaaagtaaaaggcaaatctcgtcaagctacattggaggagatatcccaaggtagtatacaaatggttgttggtactcatgctttgtttcaagatgatgtcaagtttgccgaactggtattagttgttattgatgaacaacatcgctttggtgtacatcaacgcctgatgttgcgtgaaaaaggaaagtatgccggtatttatccacatcaattaattatgactgcaacacctattcctcgtacattggcgatggtagcctatgcagatttagatatttcaattattgatgagttacctccgggaagaacaccaattcaaactattgcggtatctgaagaacgcagaaccgaaatcgtcgctagggtgtataatgcttgtgttaatgaaaaacgccaagcgtattgggtttgtactttgattgatgaaagtgaagtattagaagcccaagcagcagaaagtattgcagaggatctacaaaaagccttgccggtactacggattggtttgatacatggcagaatgaaagtgagtgaaaagcaagaagtaatgaggcaatttaaaaatgctgaattgaatttgttggtcgctacaacagttattgaagtcggggttgatgtacctaatgcgagtttaatgattattgaaaatgcggaacgattaggtttggcacaattacatcaattgcgtggtcgggttgggcgtggtagtacggcatcctattgtgttttaatgtataaatcacctttgagtaaagtgtcgagaaaacgtttagaagtaatgcgttcaagtcaagatggcttctttatttctgagcaagatttagaaattcgtggaccgggagaagttttaggtaccaaacagacgggtgttgcagagtttaaagtggctgatttaatacgagatcgtaaaatgctgcctactgttcaacattatgcccgtctattaattacacgatctccaaagttagcagatgacctcattcagcgttggcttaaaaataaagaaatttataccaatgcgtaagtgaacatttaacttttgtggaactgagaattatataagtaaagagcggtcaatttttaggaaaattttatgaggttctcaatacaaccaacaattttattttttgattcaggtgtaggtgggttgagtgtttataaagaaactaaacaacttttaccggattgtcattatttatatggttttgataacggattttttccttattcagaaaaggacgaaaaagatattattgaccgcactttaagaatttgtcagaaaatcaatcaaacttatcccttagatttaattgtaattgcttgtaatacggcaagtacggttgttttgcctgaattacgccggaatttttctattcccatcgtgggaaccgtacctgcgatcaagcctgctgcagaaatgtcagaaacaaaacatattggtttgattgcgacgaaaggaactataaaaagaacttatgttaatgatttgattgaaaattatgcacatcattgcatggtggaaaaaattggtagcactaagttggtagagattgcagagcaaaaattacgaggcggtgaagttgatcttaatgtcctaaaacaagaacttagtccatggaaaactatgaaatcacttgattctgttgtattggggtgtacgcattttcctctaatcaaagaggaaatagaatgctgtttaccgcaggtaaaattttttgtgagttctggtaaggcaattgcgaaacgggttaaatttttattaaaaggtatagaagtgcggtcaaaaattcagaaaaaaaatttgattttttgtactaaacctcttgaagatgataagtctgttcaacaaattttagattttgggaaatttgagaatttagtgatattgtctgattgagactaagcaactagataaaaataaaacttgtattttgtaattgaatagattttcactcagataaatgtaggaaaattgagcaaacagtttttattttagacaaaggagagtatttttaaaaaaaattataaaaaaagcttgcattgaactataaaatgcctataatgcacggcacacaacgacacgctgttgtgagaggttaagcagtgtgtcgttattttttgttctttaacaaactatcagacaaactgtgtgggcacttgtgagactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcaatggggggaaccctgacgcagccatgccgcgtgaatgaagaaggccttcgggttgtaaagttctttcggtgatgaggaaggcgattagtttaagagattaattgattgacgataatcacagaagaagcaccggctaactccgtgccagcagccgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgagtttattttgttagtttatttatattagtaaactaacaaaataaattttggcagtcatagtgcaatggaaccacctaactccttgccgaacttagaagtgaaacgttgttacgccgatggtagtgtggggattccccatgtgagagtaggtcactgccaaatatcaaatttagcggagtggtagttcagctggttagaatacctgcctgtcacgcagggggtcgcgggttcgagtcccgtccattccgccaatttatatctgtttaggggcgtagttcaattggtagagcaccggtctccaaaaccgggtgttgggagttcgatcctctccgcccctgccatgttttccttagtcatatatttcattaaaatttttcatctcatatcttttcatagtttcaaaaatgcaatattctattacaagacgaagaatatgcagcagttaatagaaattttggtggcattttcttatcaaaaaactcagtaaaatctatgtggagacaattgtgggaaataaaatcttaaaagggatttttttgctctatccgccgctgcgttgaatagtagtattggaatttttagcaaaaatttattagagcagaacctaaatattcaatctattgccttttttaaaacaattatcgcttttgctatgatcagtctggtgttaagtcgctcatcatggcaagaacagaaaaatcaagtaaaaccttttgcaaaaaatacagtgaacctacttttccaaatagctatttgcgcatttctggggattttaccttatttttctttgaaaccactgcttatcagtatggccatgccgctaatgtggtagtcgtactaatgaccactgctgccgtatcctccctgctcgtagggctatattattgtcagagccattgaaggtttccgccattgctggcacttgttttgccgtatttggcgtatttatcatttcttggtcgggctctagtcaatggctatctattctatatgccattcttgcaggtagtggctacggtttattttccgtactcatcaaaaaatttaatttaaatggtggcataccattaacacgattattgatgatgtttggagcgctatatttgttctatccatttgtcacacattttcaacatatagaaatccagtggaatacgactgttatactcaatcttgttgcacttgctttactacccacgctgattggtttttactgcacaaccaaggcgttagtttatctcagtgcatcgaaagtacaggtaactgaactgtcagaacctatcttcactatggtactggcatggttactactcaatgaagttccaaatcaaactttctttttaggtgcgttttgtattgtgttaggcattgcgttgatcaatcaaatgttgcaattcaaaaagtgagaagtgagttctaacaggttatgtacgctatgtgtagggtattttgatgggtatgagttttatatttaatcgatacgatttttaggcgagctgaaaactcatttttatacttacttacttcctttcttttctacaaatttaattattttttgtattatttaaataaattaattgagtgatttcaaaaaataagtatgatagccggagttttttgtttatctcttttagggagcttttatgctttatttggaatttttatttttacttttaatgctttatgtaggaagtcgctatggcggtattggattaggtgttgtatccggtattggcttagctatagaggtctttatcttccgtatgccagtaggtaaggcaccaattgatgttatgctaattatccttgctgttgtgacttgtgcatcggtacttgaggctgcgggcggtttgaaatttatgctacaaatggctgaacgtgtattacgtagcaatcctaagcgtgtaactatccttggacctttagtaacatattttatgacatttatgctcggtacagggcattctgtttactctattatgccaattattggtgatgtagcactaaaaaataatattcgtccggaacgacctatggctgcagcatctgttgcatctcaacttgcaattacatctagtccattatcagcggctgttgttttttatcttgggaaaatcaccgcacttccaggatttgagcatattaccttattagatattatttgtgttactgtacctgcgacattggcaggaactattgcattgtcactttatagtttacgccgtggtaaagagcttgaagatgacaaggaatatcaacgtcgtttacaggatcctatttggcgtgagcgtattttaaatacaactagtacaactttaaatgaagtattaccgccagcagctaagcagtcggtatatttatttttactctcgttagttgtgattgtaatgatcgcaatgtttcctgaaattcgtactatcggtagtgcttctaaacctatttcaatgtcattaattattcaaatgatgatgctatgttttggcggtattaccttgttggttacaaaaactaatccacaaattgtaccgaacggtgttgtatttaaatcaggaatggttgcagcaattgctatttttggtattgcctggatgagtgacacttattttcagtatgcaatgccacaatttaaggcaggtattgtagatatggtgaaagcctatccatggacttttgctttggcactatttgctgtttcagttgttattaatagccaagcagcaacagcggttatgatgttacctgttggaattgaattaggtttatctccagcattattagttggtctgatggcggcaacatatgcttatttctttattcctaattatccatcagatattgcaacggtgaactttgatgtgacaggtacaacgaaaattggtaaatattactttaaccatagctttatggctccaggtttaataggcgtttttacggcttgtgtggttggctacctcattgcacaagttgttattcgttaagttcatcaaataaaaagtgcggtttaaaaccgcactcataccgttaacagtttgatacgagagatattccgtaaaaagcaacatcactcagcattgtgaggtaacttttttgctttggttgtttgctaatttgtacttcacgtaattctttgacatgggcatagagatgtttttagaataaaacctcattcaatcgtcaaatgtatcttgctaaaaactatttggaatgatagaatctcaagccattttagtaaattgctgatagttttatactctcagcaatttacattttttaaatacaccgtttgattgcaaaagagttaggctaaatcaaactattagcttaatgcaatccgcacatcagaagtaaggttcagagggcggtacctagcaaacgggttcaagcattgatataaaatttattataaaatcgaccgcactttatgttgtcgaactgaattttatattgaatcggtctcactaatatttacagaggaacccaaatggtttactcctataccgaaaaaaagcgtattcgtaaaagcttcggcaaacgtccgcaagttttaaatgtaccttatttattaacaattcaacttgactcttttgataaatttatccaaagagatcctgacggtcaacaaggtttagaagctgcattccgttctatatttcctattgtcagtaacaatggtaatacagaattgcagtatgtcagttatcaattaggagaacctgtttttgatgtaagagaatgtcaaattcgaggtactacttatgctgcatcattacgtgtaaaattacgccttgttagctacgataaagatgcggcatccggcacgataaaagacataaaagaacaagaagtttatatgggagaaatcccattgatgaccagtaatggtacttttgtcatcaatggtactgagcgtgttgttgtatcacaattacatcggagtccaggtgtattttttgatagtgacaaaggaaaaacccattcatcaggcaaagtactttataatgcacgaattattccttatcgtggttcatggttggattttgaatttgatccgaaagataatttatatgctcgtattgaccgtcgtcgtaaattaccggctactattattttacgtgcattaaattacactaccgaagaaattttggatttattctttgataaggtttcgtttgagatcaaagataataaattactaatgactttagttcctgaaagattgcgaggtgaaaccgcatcttttgatattgaagcgaatggtaaagtgtatattgagcgtggtcgccgtattaccgctcgtcatattaaagcattagaaaaagataagattacacaagttgaagtaccgacagaatatatcgtaggtaaagtttcagctaaagattatgttgatttaacaacaggtgagattatttgtccggcaaatatggaaatttcgttagaattgttagagaaattatcacaagccggttataaaaacattgaaacgttatttaccaacgacctagattttggtccgtacatatctgaaacattacgtgttgatccatcctatgatcgtctaagtgcattagttgaaatttatcgtatgatgcgtccgggggagccaccaacaaaagaggcggcagaaggtttatttgataacttatttttctcttccgaacgttatgatttgtcagctgtaggtcgcatgaaattcaaccgctctttgggcattgaagacactacaggtagcggtacattgagcaaagaagatattgttaatgtaatgcgtaaattgattgacattcgtaatgggcgtggtgaagtagatgatattgaccacttaggtaatcgtcgtattcgttcagtgggtgaaatggctgaaaatcaattccgcattggtttagtccgtgtagaaagagcggtaaaagaacgtctttctttgggcgatttagagtcggttacaccacaagatttaattaatgctaaacctatttcagcagcagtaaaagagttctttggctcttcacaactttctcaattcatggatcaaaataatccgttatcagaagttactcataaacgtcgtatttctgcattaggtccgggtggtttaacacgtgaacgtgccggctttgaggttcgagatgttcatgcaacgcattatggtcgagtttgtccaattgaaacccctgagggaccaaacattggtttgattaactcgctatctgtttatgcacgtactaatgattatggtttcttagaaacaccatatcgcaaagtggtaaacggtcaagtcacagaagaaattgaatatttatctgcgattgaagaaggaaaatatgttattgctcaggcaaactcaaaccttgacaatgagcttcgttttactgatgctttcgtaacctgtcgtggggagcatggtgaatctgggttataccgaccggaagaaattcattatatggatgtttctactcaacaagtagtgtctgttgcagcagcattaattccttttcttgaacatgacgatgcaaaccgtgcattaatgggtgcaaacatgcaacgtcaagcagttccaaccttacgtgctgataaaccgttggtgggaacaggaatggaaaaacctgtagcactagactccggtgtagcggtggtggcaaaacgtggaggtactatccaatatgttgatgcttctcgtattgttgtaaaagtcaatgaagatgaaactattgcgggtgaagcggggattgatatttacaacttaattaaatatacccgttcaaaccagaatacttgtattaaccaaattccttgtgtgcaattgggagaaccgattgaacgtggtgaaatcttagctgatggaccatcaacggatctcggagaacttgcactcggtcaaaatatgcgtgtcgcattcatgccttggaatggttataactttgaagactcaatgttagtgtctgagcgtgtggtacaggaagatcgtttcactactattcatattcaagaattatcttgtgtggcacgagatactaaattaggttctgaagaaattaccgccgatattccaaatgtaggtgaagctgcgttaagtaaacttgatgaatcagggattgtttacatcggtgctgaggttaaaggtggagatattcttgtcggtaaagtaacacctaaaggcgaaacccaattaactccggaagaaaaactgctacgtgctatttttggtgaaaaagcatctgatgttaaagactcttccttgcgtgtacctaacggcacatcaggtacagtcattgatgttcaagtcttcactcgtgatggtgttgaaaaagataaacgtgcattagaaattgaagaaatgcaattaaaacaggctaaaaaagatcttgtagaggaattagagattttagaagccggtttgtttgctcgagtacgtaatttacttctttccggtggtttcaatgataaacaattggaaaacttagaccgcacccaatggttagagcagactttagttgatgaagataaacaaaatcaattagagcaacttgctgaacaatacgaagagttacgtaaagatttcgaacataaacttgaaattaagcgtagtaaaattatccaaggtgatgatttagccccgggagtattgaaagttgtcaaagtttatcttgcagtaaaacgtcaaattcaaccaggtgataaaatggcgggtcgtcatggtaacaaaggggttatctcgaaaattaaccctgttgaagatatgccatacgatgaaaacggtcaacctgttgatattgtcttgaacccgttaggggtaccatcccgtatgaatatcggtcagattttagaaactcatttgggactggcagctaaaggcattggtgatcaaatcaacgcaatgataaaacaaaaacaagatgttgaaaaattacgtggctatatccaaaaagcttatgatttaggagatggttcacaaaaagttgatctttcgacctttaccgacgaagaagtattgcgtttagcaaaaaacttgcgtaaaggtatgccattagcaacgccggtatttgacggtgcgcatgagaaagaaatcaaagcgttattagaattaggtgggttaccaacttccggtcaaattaccctgtttgatggtcgtacaggtgaaaaatttgaacgtcctgtaacggtaggttatatgtatatgctgaaattgaaccatttagttgatgataaaatgcatgctcgttcaacaggttcatatagtcttgttactcagcagccacttggtggtaaagcacagtttggtggtcaacgtttcggtgagatggaagtatgggcactggaagcatatggtgcggcctatacattacaagaaatgttaacagtgaaatccgatgatgtgaatggtcgtacgaagatgtataaaaacatcgttggaggcacacaccaaatggatccaggtacgccagaatctttcaatgtaatcatgaaggaaattcgttcattaggtatcaacattgatcttgatgaagagtaatgggtaaccacaaaaatacgcccaagtgtggtgggatttataaaagttttaaccgcacttgaataattttaactccgataggagcaaatcgtgaaagacttagttaagtttttaaaagcacaatcaaaaacctctgaagattttgatgttattaaaattggtttagcatcaccggatatgatccgttcttggtcatatggtgaggttaagaagcctgaaacaattaactaccgtacattcaaacctgagcgtgacggtcttttctgtgcccgtatttttggaccggtaaaagattatgagtgtctatgcggaaaatacaagcgtttgaaacaccgtggagtgatttgtgaaaaatgcggtgttgaagtaacacaagccaaagtacgccgtgaacgcatggggcatattgagcttgcctcacctgttgcacatatttggttcttaaaatcattaccgtcccgtattggtttattgttggatatgccactacgtgatattgagcgtgtactttattttgaatcttacattgttattgaaccgggaatgactgatcttgagagaggtcaattattaacggaagaacaattcttagacgcagaagatcgttggcaggatgagtttgatgcaaaaatgggtgcagaagcaattcaagccttgttacgtgatatggatttagaagttgaatgtgaaacattacgtgaagaattgcaatcaacgaattctgaaactaaacgtaagaaaattacaaaacgtttgaaattgttagaatcttttatccagtcaggcaataagccggagtggatggtgatgacagtattacctgttttaccaccggatctacgcccattagtacctcttgacggagggcgttttgcaacatccgatttgaatgatttatatcgtcgtgtaatcaatcgtaacaaccgtttaaaacgcctattagatttaattgcaccggatattatcgttcgtaacgaaaaacgtatgttacaagagtcagttgatgcgttattagataatggtcgtcgtggtcgtgcaatcaccggttcaaatcgtcgtccgctaaaatctcttgcggatatgattaaaggtaagcaaggtcgtttccgtcagaatttattagggaaacgtgttgattactcaggtcgttccgtcattacagttggtccatacttgcacttacatcaatgcggattgccgaaaaaaatggcattggaattattccgtccatttatctacgctaaattagaaagtcgtggctttgcaacgactattaaagctgcgaaaaaaatggttgagcgtgaagatgcgattgtttgggatattcttgccgatgttattcgtgaacacccaattttgctcaaccgtgcaccaacattacaccgtttaggtatccaagcatttgagccaattcttattgagggaaaagctattcagttgcacccgctggtttgtgcggcatttaatgctgacttcgatggtgaccaaatggctgtacacgttccattgacattagaagctcaattggaagctcgtgcattgatgatgtccacaaacaacattttatctccagcgaatggtgagccgattattgttccttcacaagacgttgtattaggtctttactatatgacacgtgataaagtcaacggtaaaggcgagggaatgttattacaagattcacgtgaagcagaaaaagcctatcgtacaggtcaagctgaattgcattctcgtgtaaaagtgcgtattactgaatatgttaaaaatgcaattggtgaatttgaacctcaaacacatttagtcgatactacaattggtcgtgcaattttatggatgattgcaccaaaaggcatgccatttagtttattcaaccaaactttaggtaaaaaagcgatttctaaattaatcaacgaaagttatcgtcgtctagggttgaaagagagcgtattgtttgctgaccatattatgtataccggttttgcttatgctgcacgttccggttcatctgttggtattgatgacatggttattcctcagaaaaaatatgaaattatttctgctgcggaagaagaggttgctgaaattcaagaacaattccaatccggtcttgtaacagctggtgaacgctataacaaagtaattgatatttgggctgcggcaaacgaacgtgttgctaaagcgatgatggaaaatctttcgcaagaagaagttatcaatcgtgaagggcagccggaaaaacaagcctcattcaatagcatctttatgatggcagattctggtgctcgtggttctgcggcacagattcgtcagttagcgggtatgcgtggtctaatggctcgtccggacggttcgatcattgaaacaccgattacagcaaatttccgtgagggtttaaatgtattacagtactttatttcaacccacggggcacgtaaaggtcttgcggatacagcattaaaaaccgctaactcaggttatctaacccgtcgtttagttgatgttgcacaggacttagtgattatcgaagatgactgtggtacacatgaaggaatcgtaatgactccacttatcgagggtggcgatgtaaaagaagcattacgtgatcgtgtattaggtcgtgtagcggcagaagatattttaaaaccaggcacaaacgaagtgttaatttctcgtaataccttattagatgaaaaactttgtgatgtcattgatgaaaattctgttgatagcatcaaagtgcggtctgttgtaacttgcgatactgattttggtgtgtgtgcaaaatgttacggacgtgatttagcacgtggacatttgattaatcaaggtgaagctgtcggtgttattgctgctcaatcaatcggtgaaccgggtacacagttaaccatgcgtacattccatatcggtggtgcggcatctgctgcggcaaaagaatctagtgttcaagttaaaaataccggtacattacgtttaacaaatgttaaattcgtaacgaataaagaagggaagttagttttaacttcacgtaacactgagttgacaattattgatacattcggaagaacaaaagagcattataaagtaccttatggtgcggtattaaattatgctgatggtgaagaagttacggcgggtgaaaccgtggctaattgggatcctcatacaatgcctgttatttctgaagtcagtggttttgtgaagtttgtggagattgttgatggactaacggtaactcgccaaaccgatgaattgacagggttatcttcaatcgtagttcaagatgtaggtgaacgtgcaacagcagggaaagatttacgtccggcattaaaactggttgacgctcaaggtaacgatatttttatcccaggcaccgatgttatggcacaatatttcttaccgggtaaagcaattgttaccttagatgatggtgcggaagtctttgttggtgaaccattggctcgtattccacaagagtctgtaggaacaaaagatattaccggtggtcttcctcgtgtagcagatttatttgaagcacgtaaaccaaaagaaccggcaattttagctgaaatttctggtatcgtgtctttcggtaaagaaaccaaaggtaaacgtcgtttgttaattacaccgatggaaggtgaaacatacgaagaaatgattccaaaatggcgtcaattgaacgtatttgaaggtgagttggtgcaacgtggtgatttaatttctgatggtgcggaaacaccacatgatattttacgtttacgtggtgtacatgccgtaacagattatatcgttaatgaagttcaagaagtttaccgcttacaaggggtaaaaattaacgataaacatattgaagttatcgtacgtcaaatgttacgcaaagcgattatcactaatgcttatgactctgaattcttagagggagagcaggtcgaagtcgctagagttaaaattgtcaaccgtaaacgtgccgaggaaggtaagccacttgtagaattcgaacgtgaattattagggattactaaagcgtcgttggcaacggaatcctttatttcagcggcttcgttccaagaaacaactcgtgttctaactgaagcggcagttgcaggtaaacgtgatgaattgcgtggcttaaaagaaaacgtgattgttggtcgcttaattcctgctggtacaggttttgcatatcaccaaaaccgccaaaaaaatcgattggtaggtggtatggaaaatacgactgaggttaaattatctgcagttgatgaggaagaaattgcttctgaatttaccttttcagcagaagatgcaacagcaaatttggcagagatgctaaatatggcagatgatgcagaataataagtagcttggtacaaaatatttaattttaaaaaccgatatttatgtttgtaaatatcggttttattgtttagataataaagtacatgcaacattattaaaaccgaaaatctgtgtcatattcaatgatcacgactattgttcaaaattttctgtaatatagaggaaacggataaacttcatttttaaaggatttgctgaaaggtattttgtatgaaaaaagctttcaacagtgtgaaatgcctgctataacttttgtaattttcgtttccgttttatacaatattcagcaacataaatgtcttcaagtaattaaccttaatagtggaacacctcatggaaaaaagcttatcccttattcctaatatcagaatgaaacgcgaaggaatgacaaatacggaaaaacgagtagttgactggttattagatgcaactaaatttaataaatccacagcattgaatgctattgcaaatgatcttgacgtatctgaggctttaattgtaaaagttgcaaaattactcggtttctccggttttcgtgatttaagaaaacaaatcactacttcttttgaagaaaatcaattagatacatttgaactttccagtcaagatacgcctcaagatcttgtagataaggtttttaatgtctctttacaaacaatctctgaaggcaaggcgattttaaattccaaagtcatttctgaagctgcaaaatgcttttttaatgctcaaaatagagatctgtatgctgctggtggttcaaatacaatctgcgatgatattgaacataaattcttgcgtatcggaattcgctgtaatacctatcgagatattcatttaatgatgatgtcagcctcattactcactgaaaatgatgtgatcttagtggtttctcattcgggtaaaacaaccgatttgttaaaagttgtctatgaagctaaaaaaaatggagcaaaaattatctgcatcacacatagtgatatttctcctattgctgttatttcggattttgtaatttgtacgcccgcaccagatactccattgctgggaaaaaatgcttcagcaagaattttacaacttattttagttgatgccttctttgtctctgtagctcaacaaaatattcacttatctgaaatgaacttagagaagacatttactgcaacaaaatacttcagaaaaaaatagcttccttccattaaaaaggtccttttttatcattaaaaactttacaatgttttaatatttgtgaagttgatcacttttttacccctttcaataaagtataattataaaaaaataaataaaaattataaaaatatgaagtttaatcattttttataatttttagttttctattaacttacataaggagtaatttcatgaaaaggttcaaaacattaaaatcctgtttggctatacttggcttagtttgctctgtttcggtttattctgctgaatatgccgtaatacttaaaacgctttcaaatcctttttgggtagcaatgaaagaagggattgaaaatgaggcaaaagcactgggagtagatgtagatatttttgcttcaccatctgaaggtgattatcaatcacaacttcaattatttgaagatttaatcaataagaattataaaggtatcgcttttgctccactttctcctgcaaatcttgttatgcctgctgccaaagcctatcggaaaggtatttatcttgtgaatttagatgaaaaaatcgatattaaaaatttacaaaaggcaaaaggcaatgtagaggcatttatcacaacagataacgtagctgtaggtggaaaggctgctcaatttatagtagataaattaggttctgaaggaggcgaagttgccattattgaaggaaaagcaggcaatgcttcgggtgaagctcgtcgtcgtggagcaagagaagtttttgttaaaagttcgagcattaaattagttgctagtcaacctgcagattgggatcgtattaaagcactggatgtagcaaccaatgtactatcaagaaatccaaatctaaaagccttttatgtcgcaaatgatacgatggcaatgggggtagcacaagccgttattaatgctgggaaacaaggtaaaattttagttgtgggtaccgatggagttcctgaagcaagaaaaatggttagcgaaagaaaactcactgccactatcgctcaagatccggcaatgattggtgcaaaagggttgaaactgcttgttgatgcagcgagagcaggaaaacaaatacctgttgatgttgagccaaaaattgaaactgttgattcgatattaatttctcaataatacggaagtatgtggggattttaatctccacataggagtgtttttctatggcaatcccattaatacaaatgaaaaatatctcaaaaagttttggtgttgttcaggcattaaaaaatgtcaatcttgatatttatacgaatgaaattcacgcattactgggtgagaatggagcgggtaaatcaactttaatgaaagtcttatcaggattgcatatgccttcctctggttcaattatcattaaagataaagaatatgatcatttagatcacaaaatcgcaacagaacttggaattgggattatttatcaagaattaagtttaattgatgaattaagcgtacttgaaaatctttatatcggtcgtttaccaacaaaaaaattttggggtattcccattgttgattggtcaaaaatgcgttctcaagcgtctattattttattaagactaggaattaaagttgacttagatgagaaagtaggaaatttatctatttcttacaagcaaatgattgaaattgctaaagttcttatttcagatgtaaaaatcatcattatggatgaacctacctcatcattgactaactcagaaattgattacttatttttcattatgaatcaattacgtaatgatggaaaagcgattatctacatttctcataaaatgaatgaaattcgccaaatttgtgaccgttatacaattcttaaggacggaagtagtgtggcttccggtatgataaaagaaatcagtaatcaagagattatccgcttgatggtaggacgtgatatagaatctcggtttatcagcagacaacatactgtgagtaatgaggttatttttgaagttaaaaatcttacaggtaaaaaatttaaacaagtcaataatgtttcattttccttaaaaaaaggggagattttaggctttgccggtttagttggtgcaggtcgtacggagttgatgaactgtatctttggcattgataaacgcatttctggggaaatttatttaaacggtaaaaagattacaccgtcatcaccattagaagcagtgaaaaaaggtatggcgtatatcacagaaagcaggcgtgagaatggctttttttccaatttttctatcaagcaaaatattgctgtttcaaaaagtttaaaagatggtggttataaaggtgcggtgggaattttttctccttcaaaggaagccaaacttgcacaacagcaacaagatcttttatccataaaatgtgcgtccattgagcaaaatattacggagctgtcaggtggtaaccaacaaaaagttattatcggaaaatggattgtttgtgatcctgaagtattaatttttgatgaaccgactagaggtattgatataggggcaaaaacagaaatttataaaattatgcgtaaattagcagaacagggaaaagctattttgatggtctcttccgaacttcccgaaattatgtctgtatgtgatcgcattgtggtattccgagaaggagctatttcctctattttagagaatactaaagcgttaacagaagaaactattatgcgttgggctttaccagagacaaaagaggtaaattaatgatgaatacaggtaaatttaatttttcgcaattttgggataaatacggcacattctttattcttgctgttattgtccttatctttggatctatatccagccaatattttttgaaagccagtaatattcagcaaatttttgttcaaagctcggtaacagtcctaattggaatgggggaatttttcgctatattgatagctggtattgatttgtctgttggtgctattttagctctttcggggatggtgacagcacagttaatgattatagggatagatcctcttgttgcctctattattggtggcattctagtgggaggtggacttggtgctattaatggtgcgttagtcaattacacaggcttacatccttttattattacattaggcacaaatgccatttttagaggtattacactcgtcatttcagatgcaaattcgatttacggcttttcttttgagtttgttgatttttttgctcaggatattttcttcattcctgtaccggttatattcgttgtggttattgctattctactttggttcgttacaactaaaacacgattaggtcgtaatatctatgcgttaggtggaaataaagaatcagcatattattccggaattgatgtcaagtttcacactatggcggtctttattatttcaggtatctgtgccggtcttgccggtgttgtttctacggctcgattaggtgcagcagagccgttggcgggggttggttttgaaacttatgcgatagcaagtgcgattatcggcggaaccagttttttcggaggaaaaggacgtatttttgctgtcgttattggtggcttaattatcggtacgatcaataacggactaaatattttacaagttcaaacttactatcaacttgtggttatgggtggtttaatcatcatcgctgtcgcattggatagattaattagtcgttaattttttgaggtaacatcatgaaagtttttatttcaccatcactcatgtgcatggatcttactaaattcaaagaacagattgaatttttggatcaaaaagtagcttattttcatattgatattatggacggtcattatgtacctaacttaactctttcaccattttttgtcagtcaagttaaaaaactcgctacgaaaccattggattgccatcttatggtaactaacccagaaaattatattgatgatttggctaaagctggttgcgacatgatcactttgcatgtagaaaccatttcaggacaagcatttagacttattgaaaagatccggtatttagaaatgaaagtcggcatcatttttaatcctgaaacgccaattgaaaaagcaaaatattatttatctaaagccgataaagttacgatattgacggtcgatcctggatttgcaggtcaatcatttattcctgaaatgttagaaaaagtggcggaacttaaattattccgagaaactcatcaattaaattatgaaattgaaatcgatggctcctgcaacccgaagacttatgaaatgcttattaaggcaggtgcggatgtgcttatagtaggaagttcaggtcttttcaataattcagataatattgttgaggcttgggatatgcttgaaaaagagatagaaagaatattaagtaaaggaatgttgtaatgaagaaagtatttgttggtattgatatgggggcaacgcacattcgcatttgtgtgatggatgagcatcatcaaattctttctactgataaaaggaaaacattagaagtactcaaaaatcaaccgctctatggactaacaacattttgtaaagaatttacaactgactttattattcaacgaattgttataggacttcctgcagcagtttcattggatagaaaagaaattctttctgtacctaacttatctctttctaaacaagaactagacggatttgttccaatgttagagcaatattttcattgtgacgtacaattggaaagagatgttaatttacaattgatctacgatgttaatgattatcaacggaataataagttagtgataggtgtttatctaggcactgggatgggtttttcaatatggaaccaaggaaagctatttattggagggcatggtgtagcgggtgaacttggacacattccttacggtgatgaacatcttcaatgcgggtgtggcaatatgggatgtttggaaactaactgttcagggactgcactaagaaaatggtatgataaacaacaagcaaattatccattagagcaactttttgatagagcaattcaagagaaattcattcaaaattatcttatcaaagtcgctaaagcaattagtactgcggttaatttatttgatcctcatactttgattttgggcggtggcgtaattgacatgcaaaaattcccatttgaacaactaaaaatattgatcagaaaacacctgagaaaaccattaccttacaatgaattagaaatattaaaagctaaaccttcctctattaatggggcaataggcggtgctatttacgctataaataaggagaaatgatgaaaacaatcgctattggttcggatcatattggtttggcactcaaaacctttttaattgaaaaattagaaaaacagggacataacttactagacttaggtgctgtttcacaagaacgtacagattaccccatttacgctgaaaaagttgcttatgctgttaagcggaatgtagctgatgttggaattttaatctgtggaacaggagttggcatttctattgcagcaaataaaatctcaggcattcgatgcgcattatgttcagatgaacttaccgcactaatgtgtcgtgaacataacaactgcaatatcattgcatttggtgccaatattatatcttcagaaaaagcgatatccttagcaacactttggctgaatacgccctatgacggaggacgacatcaaaaacgccttgacatgatggaaatgcttgaaaaaacaggaagttattgcggattggttactgaaagataaaatctataaaataatataaatatttaagaatatttaaattatgctataaccacacctatgaataaacttttctctatcggacaagcaggtaaattgctaagcgtaactattcagacattgcaaaactgaggtagaaaagactgttacaagctgatgagctgaccaaaggttggtatcgcagatataaactggaaatgcttaaagcaattaatcacaatatcgtgcttaattgagatgatttaaaaaccattgcgtatgcaagagtaagtagatacactcagaaagaagattttgttcttatagatttgttttccttgtgaataatctaaccaaatattactcggatttaatttctttttgaaggcaaaaattttattacagcagatacatttaaaacgttttttggcggtgcaatttgttattagaaaggatttaaaatgttgcgggtatttgtgttggaatccccgccctttaggacggggaagtgttgagttttagttatagaataaagtggcttaaatcttcgttctctacgacatcacctaatgctccggtaacgtaatcaccgtcaattatgacgttttgaccgctcatttcactggcatcaaaagagatcttatccattaagcgttccataacagtatgtaaacggcgagctccgatgttctctgttttttcattgactctaaaggctgcttcagcgatttttttcaccgcactttcagtaaattcaatatcaaccccttcggttgccatcagtgcttgatattgttcggttagggacgcattaggttcagttaaaattcgttcaaaatccttggcagttagtgcggaaagttcgacacgaataggtaaacgcccttgtaattcgggaattaaatctgacgggcgagcgacttggaatgcccctgatgcaataaataaaatgtgatcggtttttaccataccgtgtttggtattgactgttgaaccttccactaatggcaatagatctcgttgtacgccttcacgagatacatcagcaccgctgtattcgccttttttgcagattttgtcaatttcgtcaataaagacaattccattttgctcaaccgcatcaatggctttttgttttaattcttcaggattaattagttttgccgcctcgtcatcaattaatgcttttaacgcatctttgattttcattttgcgttttttagtttgaccggaagataaattctggaacattgattgcaattgattggtcatttcttccataccgggaggtgccataatttcaacgccgatatttggtgcggcaatgtcaatttcaatttcacgatcgtccaattgcccctcacgtaatttcttgcgaaaaatttggcgtgtgttggtattggtatctcgttcttcaatttgtccccattgatctttcgctgggggtaatagggtatctaaaactcgctcttccgccatttcttcagcacgaaaacgatttttttcaatttctgtttggcgtacaagtttcatggcactatctgttaagtcacggataattgaatcaacttctttacccacatagcctacttccgtaaattttgttgcttcaactttgataaatggtgcattagctaatttagctagacggcgggcgatttctgttttacctacgccggtaggccctatcattaaaatattttttggggtgacttcatggcgtaacggttcttgtagttgcattctacgccagcgatttcttaaggcaatagcaaccgctcttttggcatcagcttgtccaatgatatgttgatctaattcagaaacaatttcacgaggggtcatttcagacataatatattccttgacaattattcggataattcttcgatagtgtgggttaaattggtgaatacacaaatgtcaccggcaatttttaatgatttttctacaatttcacgtgcggataaatccgtattttcgactaatgctcgtgctgcagataatgcataatttccgccagatccgatcgctaaaatttgatcttcttccggttgtaccacatcgccattaccggtaataattaacgattctgttttatcagcaacaataagcattgcttctaaacggcgtaatgctctgtctgtacgccattctttagccaattccaccgcactttttaacaaatgtccttggtgcatttccaatttacgctcaaaaagttcaaataacgtgaaggcatctgctgtaccaccggcaaatcctgttagaaccttaccgttgtatagacggcggactttacgtgcattgcctttcattactgtattgccgagtgatacttgtccatcaccgccaaccacgacttgccctttacggcgaacgctgacaattgtagtcatttttgattccttaactttcttttcttttatctgtcgctatatgaggattaactgtgacctttcaaggatatatacaaaataaaattttgatttttgtagagggatagaatttaacattcttatttgaagcactaaaggagcgattgcattgaaattgattggacaatcgccgagattatattaacaatctgtcggatcaagtcgctaaatacagaaaatctctttataatgaccgcacttttaccgcaagtgcggtttctttttactatttttaaaggaagataaaatgacggtattgaaaaatgatcgttacttgaaagcgttactacgtgaacctgtggatatgacgcccgtttggatgatgcgtcaagccggacgttatttaccggaatataaagcaactcgtgcaaaagcaggggattttatgtccctttgccgtaatgccgatttagcttgtgaagtgactttgcaacctttacgtcgctatgatctggatgctgctattttattttcggatattctgactatccctgatgctatggggctgggattgagttttggtgtgggcgaaggtcctaaatttgcacgaccaattgataacaaaagtgcggtacaaaatcttccgattcccgaccctgaacaagagttacagtatgtgatgaatgcggtacgtactattcgccgtgagttaaaaggtgaagttcctcttatcggtttttccggaagtccttggactttagcaacctacatggttgaaggcggaagcagtaaagcctttactaaaatcaaaaaaatgatgtattccgagccaaaaatattgcatctgttattggataagttagcagacgccgtgatactttatcttaatgcacaaattaacgctggtgtgcaggcggtgatggttttcgatacgtggggcggtgtattgggacatcgtgaatatttggatttctcattgcaatatatgcacaaaattgttgatggcttaattcgtgaaaatgacggatataaagtgccagttactttgtttacgaaaggtggtggtttgtggttagaggcaatggcaagtacgggatgtgatgcactaggtttagattggacggtaaatttagcagaggcaaaagcacgagttgggcataaagttgcgttacaaggaaatatggatccttccgtgttatatgcttcgcctgcacgaattgagcaggaagtacaacaaattcttgccgattttggacaaggtagcggacatgtgtttaacttaggacatggtattcatcaagatgttccggaaattagtccgaaggtttttgtggatgctgttcatcaatattcaatatcctatcatcaataaaagtgcggtgaaaataatgcgaaatcctattcataaacgcttagaaaaatttgaaagttggaaaaatatcacatttatgctgtgtttatgtgaacgtatgtaccccaatttttatttattttgtcaaatgacagagcaaatggataaagccaaaatatatcaaaatattttgaatttagtttgggaatatttaaccgttaaaaatgccaaaattaattttgaaaatcagttggaaaaattagaaaatattattcctgatgtgaataattatgaattttttggtgttgtaccggcattagatgcctgtgaaggcttatcggaattattgcatgcaattattgctggagaaacactggagaaagcaataaaaataagtcaattgtcgttgcaaacagtgataactttgctggaaactcagcaagacaaagcgttttctgaagccgagttgaagcaaagtgaagaaattgaattggaattggatgtacagtggcaaatttatcgtaccctaaatgcacatgaagaaagagatattagactgattttagatttaaaaaatgagttgagagagagcaggttgtctaatatcggtatagaaattgctcaataatgtgatttagttatcaatttttacagatattacttttttttctataaaacttagattatgcttgacactactgtagttacagtaattgttgccgctggaagatgagctatctttttcggcacttttaaaaaattttaatatgaagaaggtactaatttatgaataagacagacttaattgatgcgatcgcaggtgcagcagaattaaataaaaaacaagcaaaagcggcgttagaagcaaccttaggtgcaattgccggcagtttaaaagcaggtgaagctgtgcagttaatcggttttggtacatttaaagttaacgagcgtaaggctcgtaccggtcgtaacccacaaaccggtgcagaaatccaaattgcagcatcaaaagtaccagcatttgtagcaggtaaagcgttaaaagactcggtaaatagctaagttatttttctctatctactttaaacctcgcatttgcgaggttttttgttatcttattttttctctacctctacctctacctttctttctaaatcaaaacgtatttacaattctttttttttatgtaaaattcgaaacgaaatttaaattatggtttttttatgaaacgaaacttttatcctaggaatactgaacagcgtcgtcaagtgataatgcagttactgcaagacaagggagagattagtgttgagcagttagtgcagtattttaatacatctgaagtgactattcgcaaggatcttagtgcattagaaagtactggttttttattacgtaagtacggaggagcagttttaataccgcaagagctattggaagcaaatcacgaagaattactttctaatcgaaagttagctattgcaaaagcagctgcggaacgtattgctgataacaacagaattattatagatagcggtagtacaacagccgcacttattaagcaattaaataataaacaaggcttagttgttatgactaattctttgtctgttgcgaatcaattacgatctttggagcatgcacctacattattaatgaccggtggtacatgggataccggatctgaatcatttcaaggcaaagtagctgaacaagtattgtattcttataactttgatcaattatttattggtgcagatggtattgatttagctagaggaacgacaacgtttaatgaacttgttgggttaagtcaggtcatggcagaggttgctcaagaagttattgtgatggtggagtcacaaaaaattggtagaaaaatgcctaatttagaattaacttggcaacaaattgatgtgttgattactgatgagctgttgaatgatcaaattaaaaagcaaattgaattacttggcgtggaagttgtctgcgtaagtgcggtctaaatttttttattttaaggaaataattatgtgtggaattgttggtgctgtggcacaacgtgatgtggcaaagattttaattgatggattatatcgtttggaatatcgagggtatgattctgctggtgttgcaatattaaatgagcaacgtcatgtacaaattgtacgccgagtcggtaaggttcaggcattagatgacgcaattgaaaagcaacagttatccggaggaacgggaattgcacatacacgttgggcaacacatggggagccttcagaaattaatgctcacccacattgttcgggaaaaattattgttgtacataatgggattatcgaaaattaccaagaattacaagaagttttacaacaacgagggtacatttttcaatctcagacagatacggaagtgattgctcatttagtcgaatgggaattgcgtagtgcaaacactttactggaggcggtacaaaaagcgattgctcaattgcgaggcgcttatggaaccgttgtgatgaaccaagatgagccggagcatttgattgtggcccgttccggcagtccgttagtcattgggttaggtataggagaaaatttcttagcttcggatcctcttgcattattaaatgtaacacaccgttttatctatctcgaggagggtgatgttgcagaaattacatgtcatagcgtggatatttttgattttaatggtaagcaagtagagcgtgcaattcataagaataattttgagacagatgtaatagataagggaccttatcgtcactatatgcaaaaagaaatttttgagcaacctcaggcaattatgaatactctagacggacgtattttaaatggacgggttaatattgatgccattgcaccaagtgcggaggaaattttacggcaagtagaacatatccaaattgttgcttgtggtacttcttataatgcgggtatggttgcacgttattggtttgaatctattgcgagagtgagttgtgatgtggaaattgcatctgagtttcgctatcgcaagtctgtaactagaccaaatagcttatttattaccctttctcaatcgggcgaaacggctgatacattagccgcattgcgtttagcaaaacaatccggatatatgtcagtcatgactatttgcaatatagccagttcatcacttgttagagagtctgattttgcctttatgacacgtgcaggggttgaaattggagttgcttcgacaaaagcgtttacaacacaattaacctgtttactcttattaaatgtagcacttggtcgtattaaaggctctattaatgtagagcaagaacgtcatatcattcaatctttgcaacgtttacctgctcagattgagagtgcattggtttttgataaacaaattcaaaaattatcagaagattttgcagaaaagcaccatactttatttttaggacgaggtgagtattatccgatagcgatggaatctgcgttaaaattaaaagaaatttcttatattcatgcagaggcttatgcagcaggtgagctgaagcacggacctctagcattaattgatggcgacatgccggttattgttgttgcaccggaaaatgatttgctggaaaaggtgaaatctaatattgaagaagtgcgtgcacgtggcgggcgattatatatttttgctgatcatgagttcggttttggtaatagcgatagttttaaaacgttggtattgccaaaagttgatgctatcacagcaccaattttttatacggtacctttgcaattgttgtcttactatattgctttaattaaaggcactgatgtggatcaaccccgtaatttggcaaaagcagttacagttgaataaaaaatagtaaaagtgcggtaaaatttaccgcactttggttatttgattcaagttgctaccgtaaacagctattaccagccttttgcgacaccgtctttaaagtgcttataagcttcttgataaacttcctctgtttgataggcttttacaaagttttgtacttctacgctgtctttattatctttacgagcaacaataatattaacgtatggagaatctttgtcttcaacaaagataccatgttctgcactgtttaaaccgacttgacctgcgtaagtattattgacaacagctaaagctacatcatctaacgcacgagcggcaacagaagtatctacttctttaatctctaaatttttcggattttcgataatatccaatgcagtagagaataaatttgtattatcttttaatttaattaatccttgtttttctaataaaatcaacgcacgagccaaattgcttggatcgttaggtacggcaactgtatcaccgtctttcaattcgctgatattcttaatttttttagaatagccggcaagcggataaacaaaggtgttacctacaatttctaaattagtgatatttttagattgtgtatctttatctaaataaggtttatgttgcatcgcattaatgtctaaatcaccttttgataccgcagcgttaggtaacgcataatcattaaatacgacaaattccactgctaagttatatttttctttagcaatttgagctgccttttctgccacttgatgttcaggacctgccattacgccgactttaatttttgccggttcgttttggtttgctgctgtttctgtttttttatcatctttacaagctgttaatgcaacagttgaagcaatggcaatagttgcgaaaagtttgtttaatttcataagatttcctcttaaatagttgtgtttaaaataaattagcgatgatcaacttttttagctaaatcatcccctagtttttggctaataataacaaataacacgatgataatggttgaaatccaagtgatgaatcccatgccacgatgtactccgtagttaatagctaaacttcctaaaccacctccgccttgggttccagccattgcagtatagccaattagcgttacaaaagttaatgtaattccattgataagagagggtagagcctcaggtaaatagaattttgtaataatttgccaattggtagcccccaatgcttttgctgtttctgttagaccggttggaatttcaaataatgcattgctggttaagcgagcaaagaatggaattgcagcgacacttaaagaaacaatagcagcattggttcctaacgaagaaccaacaatatagcttgttacaggaattaagatcaataacaaaataatataagggacagatcgacctatattaataatgatattgaaaattttattagcattgctattttccagaatttgttttttgcccgttaaaaaggttacgcaaccaataggtaaaccgatgaggactgcgataaacgttgacacaatcgtcatataaacggtttcccaagtagaaagagcaattttgctccacatttccggcgttaattgttgattgaacgtaattagcagattatccaacatagcctaatacctccacacggacgttattttccattaaataaattttagtttgcgtgatggcttcttcctcaccttcaacttcggcaataacaaagccgaattttacctcaccggcgtaatctatttgtgaacttaaaatactgagatcgacgccaaattgtttagatgcttgagataataacggggcatcaacggagcgaccggtaaattcaaatttgataattgggtaagattttgcatgttttggcgttgccgataatttttccatatattcttccggtagattaatatggaaagttgaatgaataaactcttgagcaagaagggttttcggattagagaaaatatctccgacagaaccttgttcaattaattgccctttattaattaccgcaacttgatcgcaaatacgtttcaccacatccatttcgtgtgtaatcagtaaaatagtgatacctaaagtgcggttaatttcttttaataattttaaaatagattgtgttgtagccggatctaatgcactggttgcttcatcgcacagcaataccttaggactgtttgcaagtgcacgagcaatagcaacacgctgtttttgtccgccggataaatttgccggatagacatcttttttatcgtatagtcctactaaatttaaaagagcgtcaactttttgtttaatttgggttttatccgttttctctagttctagcggcagtgcaacgttatcaaagactgtgcgtgagcttaataaattaaagtgctgaaagatcataccaatatgacggcgagcatgaattaactcgttatctgaaagttgagttaaatctgtattatctacaatgacagagcctgaagttggacgctccaataaattgatgcagcgaataagagtactctttcctgctccggaggcaccaattactccacatatttgtccttgaggtacttcaagactgacattatcaagtgcggtcagatttttgcctgaaacattgaacactttactgatattttttagcttaatcatataagcccttttctatatagttaaattaaaattagcttgtattttagacgtctagattgctatgtcaatatttattgaatagatttttataaggatttatcagttattggcgatataataaagaaactttgtttttcatagaggtattatgtatatgaataaagcgatttttttagatcgagacggcacgttaaatatcgatcacggttatgtgcatgaaattgacaaattccagtttatagcaggaagcattgaagcattgaaacaacttaaatctatgggatttttattggttttagtcacaaatcagtctggcattgcaagggggtatttttctgaggaacaatttttacagctcactgaatggatggattggtctcttgcagacagaggcgttgatttagatggtatttactattgtcctcatcacttagaaggaatcggggagtataaacaagattgtgattgtcgtaagcctaaaaatggcatgctactgcaagcaataaaagaattaaacattgatcctgcaagatcttttatggtgggagataagaaagaagaccttttggcggggaaaagtgcggggataaaaaagaatattttggtcagaagcggtaaagaaatcaccgatgacggattgcctttggctgattatgtgttagatactattgctgatttacccgaattaataaaaaaattaaaattttaaccgcactttttattaaaaaattaggctatgtcttaaaataagattgaatgatgaaattcagttttttgcgttctgtttgcataattgctcattctgtacatacaaaaagagataacatttctgctatctctaatgcctacaatcatattttttagtttctacctacaacctgttttgttgcctctattttcttatctttccataaaacaacatcttttataacaagtttttggacagcagaaataagaagttccatataggaaaagtctatttcgttattttttgttggcagtttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaacgcttctttctcctcgctagacaattcataattgtctaatccgcttaccgttaggtaagcggagagttcgcttatacgctcctcttcgagttcgcttataaagctctccataaattcaaaatctattttgccgtctttagttggaagctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacttcaaacaaatctccaattctatactcgccccactgaacattttggagtttttcattcagtgaggcatttatttttttaggcgttcattctccttatctgtatttttaagaagagtggatacttcccaagcaaggtaatcggctacagttttcttaaaatcttcaagtgttggtcttgtatctatcggtgctgattgattccagtctgaaccatttaaagggtcaatatgaccttcgtaatattctttttctgtaaagatgtttaatttttgttttccaaaacgcacaaggtctaccacttcctgatatctttcttttgctctgtctgtatctctaagatttacacttgctttttttctgttcgttcttgtgtaaccatcatttgaaaaatcgataaacttaacgacttcatctctttgatgagattcgcctactctaaatacataaatatttgtttgaacacttgattttccaacaaataaatcgatgggcattttaatacttgcaagtagggtattgttttttagaatttttttgtttatttctgttgctttgccacttcctgcagagttttgaatgatgattgctgcatagcccttgttcatcatagatagggctttttctacgaaaatcattccattgccctctgctgaataaggcggatttaacacaaaagcagtagctggaaatttcgcatctgttttaccaaatccatatttaccgtcaaaatcatgtagtgagtctttgtttaaaatgtttgaggwaccatctcccataagtatcatatttaaaatggcaagcatatagatgttggatagaacttctaagcctaaaagctgttctgcttttatctttagttgtttttgctctagctcaagtggtgatgtgatttttgcttttgcatctataatcatctcgttcattgcagcaacaagtagccccgcacttcccgttgcaaaatcccacacatagctgtctttatcaactcttgcaagttttactaaaaaagttgctacataagatggggttaaaacaacatcgtttaatttgtcttgcgtaaagccgagccaagagtacatttcattaaagagcttacctgtaaagtctgtagttaagcctattttgtagtagatacctaggtcatcaacgattttagcaaatattctttttaattggctttctccgtttattggcttattaatattttctgatagtaatgtattttttagtgttcttacgataaggtcttgttttgtttttggtaggtttttcttttttaaaaacgcttctatttttctaacgataatttcgccgtctgtgtttccctcttctattgatgattttaggtcagacttttctagtggacttacccccccccggtattcctagtgttgccataatagaagctgacacaagatagactctgtcgttttcactaagccctttttcatttgcgtaaatatcattgtttagctttactaaacttgcatttatttctttttcacgtttttctttaagtgcttcaagttcttcagcagataaagaaagttcgtttacttttttaataaaatctgtaaagttttcttttcttaaaaatgaaaggtctgtgtattttcctacttcttgccctatcccaaaattatcttttgatacatagtaaacgccaatagagtgttctatttctccgttttcttttttatatcccgtaacaccgattgctattacatttgtgtagcttgtgtagtgaagtatggcattggcataatgaaccgctccatttacagcatagctattaatatttttgtaattaggctcgtttttacttgttctattgtcaactctaccgtcaatgtctaactttactaatttatctttatatcctttatattctatcagtattggataatagttaagtgcctcatcttgcaataaaagcttagcatccggtctatttccacccgttccgccactttttgatttatattcatcaagtgccttatctatttgtgcatttagactttcttgttctaatttataatctaacccataacttttaagccacccatttacaaggtcaactatgtttggttctatagattgcattttaaccattgtctattctcccttttcaacatattcatcatcaaaagaaaatccatcgttcggtgtgcagtcaaatgccttgaatattctctctaaatttttaagcgttatcggtttatttttcccatttttgccataatattggttgttaaatctgacattgttataacatcaattttccttaagcctgtcaatcgtattttagaatgcaaccaaaaattatcttaaaaacccttaataataagggtttttggtgagagagtttttaatgagaacgttgtactagcaagtgcattctagcgatattttgagcggtagattctagattttgtctgccttgagccaaaatttcaggcaaactgtctaattgacgaataatggggaatactgcatcaatgccatgctcatagactacttcataatcttcccgtaagcagcctgtaatggctataacaggtttatttgccagtttggcagtttttgctaccccaataggcgttttgccgtgaatagtttgtgaatccattctaccttctccggtaatgaccaaatcggcatccttgataatttctgctaaatttactgtatcaatgacaatctgcacaccggatttgagttgtacttgaggcaataatagcaatccaccacccataccgcctgcagcacccgatccgggacgctcagcaatccattttccgcaatctcgttctacaatacgactaaaatgcagtagagcttggtccaattgttgcaccatttccggtgttgctcctttttgtggcccgaaagtagcagaagcaccttttttaccacataaaggattatttacgtcgcaagctacattaaattgaacttgtgtcaaacgttgatctaaatgtgcagtgtcgatatgagcgatttgttgcagagctagaccgccaaagccgatttcttttccttgagcatctttgaatttgatacctaaggcttgtagcataccgacaccaccgtcattggttgcactgccaccgatacccaaaataatttggctcacccctagatccaaggcggcgttaattagttctcctgtaccatagcttgtggtgtagtaaggattgcgtttttctatcggcaccaaatgtaaaccggaagccgccgccatttcaataattgcgatttttccatcacccgatatggcaaattcagcttgcgttttattacctagaggtgcggtaacctctacagaaatcagtttgccttgtagtgcatcggcaagagattggactgtgccttctcctccatctgccatgggaacttttacataatctgcattggggtagatttttttgaaaccattttcaatagcttgagccacttcaagtgcggttaaactttctttaaaagaatccggtgcaatgacaattttcattttagttctccttgatagtgattgattaaaataattgccatacaccaaaaatcagagtagagataattgtcatgatcaaacctactgcagtttcgtatgggattagttttaaccgctctttaatatccatattaacactaccgccggttgcatgaaagaaagaaccatgaggcatatgatcgaagacggttgcaccagcatgaatcattgcagccgctgcgataccgctgacgctcagttcaattaaagttgctccgaacacttgagacgctacagcggttcctgctgtagtggaagctgtggctaatgacattaatcccccggaaatcggtgctaatagataagaaggtagtccggacgcagttaacccttcaattaagagttcttttaattcggaattagcgattacaccggctaatgttccggtacctaacaacatcacagcaacaggtgccattttacctaatcctatcactgcatattgatttaagtaacgtgttttattcatgcaaattgtgcctacaataccgccaagaggcagtgcgattaaaggatcaatttttatgccgaataatgggcgaagggcaagtaaaataatagtaaagagcggtgcaataattgctggcaagaattttggtaattcgccggtgatcccaacgatttctttttcacttacttttgagcctttattcattaggcttttggctagaaaataggtgatgattagaccaaaaacagcaggaatgatgcccgctgtcatcactgaagttagagggatgttgaaggcatctgatgcagcgatagcatttgggttaggagacataatattacctgctttaccacccccaatcatggctaacaaaatagccattttggataaattgctacgttttgccaatgccagtgcaatgggggcaactgtgatgactgcaacgtcaataaatacacctacagccgttaataacattgcggcaagaatgagtgccaacaatgatctggattcacccagtttttttacgatagtatcggcaatagtacttgccgcaccggattcaattaatacacctgccagcacaccagcggctaaaatcctcataacagcggtagtgataccttgtgccccgcctatcatcagcgtaactgtttggcttagatccgcacctccgattaaacctcccacaagtgcaccaataatcatgccataagcaggtgggacttttttcaaaatgagtacaattgcagtaaaaagggcaacaattgccccgagagcagttacagttatcatgatcgtttcctcatatattaataaaaaatcatgttgtgtattattgaatgtatgaggttaaaaaatcttcatatataaatacaaaaatacctgataaataggattattttttgtatatttatacaatttattggtttagcaatgtgcttaggtagagtgtaaatttttcatctatcttattgaaagacaagccggttattttctcaatcttgcttagacgataccttaatgtattgatatgaataaataattgttgtgaagtgagagtaagatcacaatttgaaaaaaaatactgttgcaatgttttttgtaacagatgattttcgtcttgttgatataaggtatcaataggttttaataactccttactttgccaagtactacgtaagttatctaataacgcaggcaatttatattgattaaagaaatagatggatttcttaggaaaataagtttccccataacgaagggtactaagtgcggtctgaaatgaaagtgaaatgttgcgattattttcaacttcggaaccgatagccactttcagcccttttaatcccgaaggtaatagataaggaggaaataatttctgtaatccttttgtaccaagtaaggcttgaagttcttcagccggttgtataagtgcgattttatcatgcgataagattgcgaagtggttgatcgattgttctaaatatccagcaagcttttgaagtttctctgctgtgggatgcaaaatttggataataatgaccgcacttttagtatgtagcgttagtccgaaaaaagcactttgtttctcaatttctgcctcgttgagtttaccttttaataaacctagaataaactcttctttataacgtttatcccaacgttctttttctaacaaaaagtgttgttcaatcatcaattcagcagtcattttaaccatttcaccataggatcgaacagtgtcgggatctccggaaatacctacaacacctaaaatttctcccaaataactaatgggaagattaatacccggttgcacttcaaataaccatttttcagctaactcctgagttatttctatagtttggttgtgacgaatagagtatatggcaccaatatgtctttgttgcaaacggtgaggattacttgaggcaataataatgccggtttcattcattacattgatgggcttatgtagaacacggtttgttcgttgcacaatattttgagctaaagaaacgcttaatttcatgttcatagcaggacatttactgtaattatcaatagagtgactctcattttatgagaattttagacaaggtaaaagtataaaatttcagcaagtaaaaaattttttaaaaaaattacttgcattgaaatataaaatgcctataatgcacggcacacaacgacacgctgttgtgagaggttaagcagtgtgtcgttattttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgatatggccctgagtggagacactcagggttttttgttatttgggataaggcggggaagagagaagagggaagaggaaaatgggagaaaaaaagtaataaggtgataacaaggtagtcataaaaagtagggtaatgaagcagagtgaagaggtgcggtaggaaaatcgtttttttttctaccgctctttttgtaggtratttatttatcgtttgccttattcatacgtccggcaaacaatatctttttcttcacaaaacatctcactatgctgtgcttgacactgtctttgtacattaagtttagctcgkcctctgttgstatgctcactgcgatattcttgagtaaatggttttaatgtacaaacatgaatagcatcaaaatcagtttgttccgaaacaccgatgaaaattggaactggaatggctgtttgatcttttgttgatgtcggtacaacgcaacttgttaataatatacacaaaccgattaaacaaaaacgcatatttttctcctaaaaataaccttaatttcaaattttaagacgattttattatactcaatttttacaagaatgttcagagaaatgacaaaacatatagttttactttttctccataaaaatgtaggcatgatgtaattgaaactaagttgtatctcgtgtttaattaacattcatgccgatatcgaaaacatataagcaatatttgcttcgtttgttacaaattatttttcaattcgtaatccataagatttaaatttctctaatacaatctccatttcttttggagttaacaatgggatttctaaacctgtcgctaaaagtttcatgtaccattgagccaagacttcaacttcatgggcaagccataatgctttatcaagatttttttccgcagcaattaagccatggtgtgctaataaaattgccttactttcttttataccttgtttgacatgctcagccagttcatgcgtaccaaaggttgcataaggaacacaaggaatatgatcggtaccacctacggcaatcatgtaatgaaaaggaggaataggtttttctaaaatagatacagctgcacaattgattgaatgattatgtacaactgcatcaacatcaggacgtgcttcatacacagctagatggaaatgccattcactggaggggaatttgccttcttcatgtttgccatgtttatctacataaacaatgttgttttcagtcagcaattcatatggcatgcctgtagaagtaattaacataccgtctttatatctgacactgacgttacccgcagttccttggtttaaaccaagtcttgtcatttctaaacaggtgaagataattttttttgaaagtagtgatctatccatttttattgtccttctatttcacaggtgtaacaccttttttaataataatattgccgtattttgcagtttcaccggtaataactactgcataagcctgttttgctcgctcataaaaagcaaaacgatccattcttgctaatttaggcacattacctaccgcacttttaattgtttgaagatagctttgctccacagcgggatccaaactatccccttcaactgcttgcatcataattaacggtgcctcagtataagtatcaaactcaaataaaggggcaatacctgtcagtaaagaattgatactaataccgtcagcacgaacaactttatgatgcaattgatgagctggaaaatgagcatcagataaaactaactcatctccatgtcccatttctgctaaaattttcaacaaatccggtgaaattgccggatgaatcccttttaacatatatcctcctgaagttttttataaaattccatatctgttgaaggttcaattcgtcggaatgtcggcttcattttttgctgtgcctcttcgacgtttgcaaaaacacccgcaccggttaaagtaaacatagctgcacccaatactgtactctctgctatatcaataacatcaatagggcaacctaagacatcagcacgaatttggttccaaagtttatttttagatccaccgccaaccacaatcaaacgatccgcactaaaatttcccactttttgtaatacattcaagcctgcttttagacggtaagccatgtattccaaacctgcacgataaatttcgccacgtttcgtatgcattgataaacctttgatttcacctgtttgttccattttgccgtcaaaatttcctacgagcttcacgccattggaaccggcaggtactgttttgccctctgcgatcatagtttggtaatattgctctttggttacatcggaaaagaattgtttgcccaaccattcaatcacacccgaactaacccattgcactcccggattaaaagcaccaggcagactatcaaattctatggttaaaccatctctgacatattgccattgtgcttgagcttgctgtgttcttaccattaaaatttcccaagtgcctgaactcaaaacaggttggttatatccggcaccggaaccgaaaatagcaaattgagtgtcatgtccacaggaaagtactgggatatgtgttgataaacctaaatattttgccacctcaggtaataaattacctattttttcacccgctcttttcatcggtgggaaatgttgttcattcaaacctagaaaatctaaaacctctttatcccaagagtcattttctatatttgtcatcattgatgtacctgccatagtacgatctgtactaaattgacctgtcaaacgttgagttaatatagatgaaatgaatacccacttatccatctcggcaaaaatatccggtttattttctttcaaccacaataatttgaacaatgtattgaaactatattgtccaataccattacgctgatagagcttttttacatcaaggtattgatgaagtttctccatgacaggcaaagtgcggggacatttccaagaaattattggaaaaatttgcttcccatttttcgaaaaaggagcaccatctacaccaaaggtagtaataccaatccctttaatttcagctacatcaatttgtttttggcgtagattcacaattgttttttctgcacaaaaaataagtttttggtagatttcttcaatgtcccaaatatgataaagagagttttcaggatcaggttgagtgtgattaggtgtatgatgtgatgcaacgattttacctgcttcatttattgcaatggtacgtaaatttgttgcaccacaatcaaaaatcaatgcaattgccataataactccataaaatcatgagcttattgcttaattaagaggggaaatttagtccttccccctccccctggatttcataaattaacgatataaaggaccaaagtttgcacaagcacggtaatcttgaccttctttatcttgaccaaatgcactccaagcacttggacggaaaatgtctttttcttcgacattgtgcatacagactggaatacgtagcatggaagcaagagtgatcaaatcagcaccaacatgtccataacttgcaacgcaatggtttgccccccaatttgccatgacagaataaacgtcagtaaatgctcctgtacccgttaaacgtggaacaaaccaagtagttggccatgtttgatcagtacgtttatttaaaatatcatgcacgttttctggtaaagcaatagaccatccttcggcgatttgtaaaacaggcccaatacctttgactaagttaattctatgtatggtaaatggcatcccgcctttagttaaaaattgtgacgataaaccgcctcctctgaaatattcgtgtaccgccggacaccaacgagtattttctaagcaacgctttccatcttcttctgttacttcccataccggtttaatgactgatgttccgtttggatctgtatgttgtcccgtaccatccaaagcggcagagccggaatttagtaaatgaataaatccactttcaggacgccaacctgttacacgctcaacagaatcttcactccaataggtacgtacatcagcaaaaatttgagcctgaccggttagcaaattgccgaataacatgttaacgccatttaatgaatcattttctgtggctaaaatataaggaggacgtacaccgttccagtcataagttgaattcaatattgcttccataaagtcgccgttcggtagatgatctgtccaatggcgttgaccttggaaaccagcaccaatcgcattatgtcccattgattcttctacataaccaagttcagctaaacgaggattaccaaccattagatctcgacaaataatcgtcattttgacaacattttcccaaagttttgctcgttcttccgaactacgctgattttcttcagcatttacatcaataccttctttacagtattgagtgacccattccatcgctaatttaacttctttttcatcatagattttgcgatctaaacggcgtttaatttcggtcatatctacatattcattacgcatatccaaatattcttgaaagaatgcttgattaacgatagaaccggcaatacccatagaaactgaacctatagataagtaagatttaccacgtaaagtcgcaactgcgagaccggcacgagcaaaacgtagtaatttctctttaacatctgttggaattgttgtatcagatgcttcttgaacttcagtaccgtaaatagagaatgcaggtagccccatttggttatgtccggcaagagccgctgccaaatacaccgcaccgggacgttctgtaccgttaaagccccaaattgcttttggcatatggggatccatatcgattgtttcagaaccatagcaccagcaaggggttacagtgatgactgcaccgacattttcacgtttgaatttttcagcacatgcagcagcttcagcgacaccaccaatcgtggtgtccgcaattacacatttcacaaattgcccatttgtgtgccgcacttccgtttcaattaattgagcaaccgcttttgccatattcatggtttgatcttctaaagattcacgaacgcccatacgacgtccatcaatagttggacggataccgatttttaccggtgttgattttaaatgtgtcattttttattccttcttgatgattaagtttattttttcacaaaaaacaacagaacatagttttttgtgtaatttgtaaaattttcgtgagataaatcacaaaaaaatccttttttgggttaaatttcttgtttttatttgcccgatttttaaatgattcatgatttttcgggcaaaacgatcaaatcaggcttcgaattatttcaataccttccaacttctatagccataaatagtaattggaataaaacagattaatggtagaacaaaagaaatgttcacagcaggcaaattaaaaatttcacctttatcaatgatcatgccttgtaaaggtggcattaatgcaccgcctacgattgccataactagaccagcggcaccaagactagcctcttcttttaaaccgtataaggcaataccgtagattgttgggaacataagagacataaaacctgaggttaaaattaagcaatataatcctaattctccatcgataaaaattacgcctacaatgcttaagaaaccgccgataccaaataggcataacatcaactcagcttttaagtatttcataatactggtgctgataaagcgactggcaacaaaaattatcattgcaataatattaaaattttgtgcttcagatttagtaaaacctaagcgttcggcatattggataataaaggtccagcacataatttgaacacccacatagaaaacctgagcaattacaccttcacgatactttgcattttggattaggcgagaaaatgcgtctttgaatgcaattcttccccccccccctagctcttccatttttgtagtaggcattttgtataaactaatgactaacatgatgattaaaacgacacctccaacagctaaataaggattacgaataatttctaaatcatgggtgcgtatagtcgctttttctgcggtagataaggtattaaaaattagatttcccattgcatcacgtttttcagattctaggctggttaatactacttgtgatgccacaaacatacctgtaatcgaacccaacgggttaaaagattgtgctaaatttaaacggcgggttgcggtttgcggatctcccatcgaaagaatatatgggttggctgtagtttctaaaaaagctaacccaaaagtcagaatataaagtgatagtaagaaaaaagtaaattcttcatacaaagctgccggatagaataagaatgcaccaactgcataaagggctaaacctaataagacaccggatttataattaaatcggctgacaaaaagtgcggctggaattgccattgttccatagcctccataaaaggcaaattgaacaagagcagcttctgatgctggaatttccataacagtttggaaaacggctaccattggattcgtaatatcatttgcaaatccccacaaagcaaacaaactggtaattaatataaaaggtgcaataaattgcttttcaagagttttagctgtcatttttctttccttaattatgagagtagtttcaaggattacattctcgtaaaattatgctgcgtgctttgcatcattttttgaaagaatgttaaaactattagaaaggaaaaatagaaagacaataagaaatttatgaaagtagttaaatttctgtgaaattcatcacaaaaaacgctaaaaaaattaaaagataatgcccgaattaaatcaattcttttgtaaatcgggcattattttgtttggataaagaggatttaaacaatagtgattaaaacatcagatttctggcagtatgatgtcaaagttggatttggaacttggtctgtaaataaaatatctatttgtgataaatctgttaaacgaatcaaatttctacgttcaaacttagaactgtctaataagagaaatttctgttcacaagcatccattaatttacgtttaattgaggcattaagctcatttgattcccaaactccaccgctactatcaatgccggtgcaagagaaaatcccaatatcaatatgtaaacgttgtaataattgttcggataacggtccataaaaagcatcatatttcactgaataaacgccacccgttgcaatggttttaatattaggtttattaacaagtgcggtaatgttatgcatagaattggtcactactgtgcaaggaatatcggggatcatttgtgcaaaatgccagctggttgaactggcatccaaaccaagtacaataccttcaaacatatattcaatggcggaagcggctatggcacgttttttatcgcaattaaagcgttgtcggctttgaaaagaactcccgacatctttcgctttacggctgacagcacctccatgtacacgatgaattaaccctctcttatccagatcggttagatctcttcgaatagtttccacagatacgtcaaattgtttagctaaatcatttacattcacttttccggatgaatttattaattgcaaaatcaatgtttctcttgatgacatttcttttctccaagcagtcaagatggttacgaaagattacacgctaaacgatagtaagatcaactgttgaaaaattaccgcactttgccttaaatttattttactgtcattggtagtgttaatatgttcaagaagaattgcgtcagatcaggaaaagctgacttttcactttaaaatatactcattttttgctataaagtcggcagttttttacttaatacttaggagatattttatggagttagtatttattcgccatggttttagtgagtggaatgccaaaaacttgtttactggctggcgtgatgtgaatttaacagaacgtggtattgaagaagctaaagcagcaggtaaaaaattacttgaagctggttatgaatttgatattgcatttacctcagttttaactcgggcaattaaaacctgcaatatcgtgttagaagaatctaaccaattatggattcctcaagtgaagcactggcgtttaaatgagcgtcattacggtgctttacaagggttggataaaaaagcaactgctgaacagtatggtgatgaacaagttcacatttggcgtcgttcttatgatgtttctccaccggatttagatccgcaagatccgaattctgcacataacgaccgccgttatgctcttttacctaaagacgttgtgccaaatgctgagaacttaaaaatcactcttgaacgtgttctgccattctgggaagatcaaattgcacccgcacttctttccggtaaacgtgtacttgtcactgcacacggtaattctttacgtgcattagcaaaacacattatcggtatttctgatgaagaaattatggcttttgaaattccaacaggtcagccgttagtgttaaaactggatgaacagttaaattttgttgagaaattctatctataatttctttatatacctaatcaatggctgagggtatctcagcctttttgtatcactttttacattgatttgattttatcttgtcgcaattcctctttaatttctgtacaattggcagattttgtgtttattgagatattctatgagttcatccccaaatattggctttatcagccttggttgccccaaaaatttagttgattctgagcgtattctgacagagttacgttctgatggttataatattatttccagttatgaaggggcggatttagttattgtcaatacctgtggctttattgatagtgcggtgcaggaatcattggaatctatcggagaagctttagagaataacggtaaagtgattgtaactggttgtttaggggcgaaagagaaccaaattcgtgaaattcatccgcaggtgctggagatcacaggtccgcatagctatgaagccgtgatgaaacatgtgcataaatatgtacctaaacctgaatacagtccttatactagtcttgtgccgaaacaatggataaaactgacgccaaaacattatgcttatttaaaaatttcggaaggttgtgatcatcgttgtactttttgtatcatcccttctatgcgaggtgatttagatagtcgttccattgtgcatatactcgatgaagccaaacgccttgtagatgctggtgtgaaagagattttggtagtatctcaagatacctctgcttatgccttggataagaagaaagaaaatgccagtaaaacggtattctggaatgggatgccgattaaaaatgatctgattactttatgtgaaaaattaggttcgctcggtgcgtgggtgcggttgcattatgtttatccttatccgcacgtagacaatctcattccattgatggcagaaggtaaaatcttgccttatttggatatccccttacaacatgccagtcctaaaattttaaagatgatgaaacgcccgggttcaattgaacgtactttagagcgtatcaaaaaatggcgtgaaatttgtcctgatttaactttgcgttctacctttattgttggttttccgggagaaacggaggaagatttccagttattattggatttcttgcaagaagcacaacttgatcgtgttggttgttttaaattcagtcctgttgaaggtgcggtcgccaccgatatggaagatcaaataccggaagaaatcaaagaggaacggtttcaccgttttatgcagttgcaacaaaaaatttccgctgaacgtttacggcaaaaaattggtagaacattacctgtcattattgatgagattgacgaagaaggcattattggtcgtacgatggcagatgcaccggaaattgatggcgttgtttacgtagataatttttcaaaagtggaagtaaaactcggacaaattattaatgtaactattaccaacgcagatgagtatgatttatggggagagatttaagtgccgttaagtgcggggtgaattaccggaatatttattctccctcagaagcagtgatatattataaaattcaatttccaggatatgtatcatgttatttttacgacaaaaattcaaaaatagattaaaacttaccgcacttttttatgtagtttatttgcttttttcgtttgttgctcgtgccaatgaacttactcgcctccaagaaaaaattaagttacaagaacaaaaaattgcacaacaaaaaaatgaacaaaatgaattacaaaacatattaaaaaatcaagaaaatcaaattagtcaagcggaagataaattacgtcaaacagaagaaaatttgaaagaaacacaacaacttatcagtgcaacagataaacagataaaacgcttggaaatgcagctcaaaagtcaaaaaaaactgcttgcagagcaaatagataaaatgtaccgagctgagattaattcttccgcagttgaaaagttgttttctcaagaggcacaaaaatctgaacgtatgcagatttattatcgtcagatgaatcaaactcgtttaaagttgattaatgaaatccaacaaactcaagaacagctggagaatgaaaaagcccttattcaaggaaaaagaaaaaatcagcaaaatcagctgacaacacaaaaacaacaacgacaagaactacaaagattacagcgtgagcaacaattaatgcttgaacagctgaatcaaaatttagtaaaagatcaaaataagttggagcaattaaaggcaaatgaaattactttgcgtcaacaaattcagcgagcggagaaaattactaaagagaaggaacagcgagagcgggcagcattggcacggaaaaaagagtcggaagaaaggaaaaaccgaaaaccttataaaccgacagcacaagaaaagcaacttatggcaagtaaaaaaggtttaggtgttgcaaaaaaacagtattcttttcctgtacagggtaaagttgtacaaggtttcggtacaggtcaaatgggagaattgaaatggaagggcatggtaatttctgcggtaaaaggttctccggtaaaagtaattgcagatggacgggttattttagtcagtcgtcttgcaggttatggtttaatggtaatcgttaaacatggagagcatgatctcaccctgtacggttacaatcaatctgctatggttgaagaaggacaatttgtgaaagccggacaaaaaattgctgaggttggtgatacggggagttatgcacttccggcactttattttgagattcgtcgtaaagggatacccgttaacccgatgggttgggtaaaataaaatgagaagaaatatatgtattaaaagtgcggttaaaatcagtcttatggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgccaagcaacgtgatcaacaggcaaaacaacaagatagagatattttaattcatttgcctatgcaaccgcttaatctgcaaaaaattgaagacggtggaataaaattaggtatgtcgcaaccggaagtttatcatcgagtaagaaatgccaaaagtattttacccaatgctataggtatgaataatcacatgggaagtgcggcgacagcggataaagatttaatgaacaaattaatgaccgcacttttgcaacaagatttattctttcttgatagccgaaccattgggcgatcagttgcggggaaaatagcgagagagtttggtatacccactttggaacgtcatatttttcttgatgatagtgataaacttagtgatgttcaacgccaatggaatgcagccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataatagaaaatacatgattgaagaataaacctctgaaggattttcagaggttggaagttaagggcgaatgtctcgtaagataggattttgcatagaaattaatgtttctgtagattgaatttcatcaattaattgaatttttgtagcaagaactgaatgaagttctgcaatagtatgggtcatgactttaataaaaatagaatagttaccggtcgtatagtatgcttcaactacttcattgatattctctaattgcttgataactttgtcgtaatctttagcactttttaaaataataccgataaagcaacatacatcataacctaatttacgttcatcaatgcggatttttgtgccttgaatgatgccggattgacgcattttttctactcgcacatggatagtgccgggactgacaccgaaatttttcgccatttctgcataaggtgtacgtgcatctttgattaatactcgtaagatttgttgatctaattggtctaaatttggcatatttatttttccttattattcataattagaaaatatataaaaatattatgctatttttaatataaattcaatattaataaaaaaataaataaatggtattgaattagtggtatgttttattaaataatacctaacgtgaatttaatattcaattactcgttattaattattaggatgtatgtcatgaaaaaatcatttattttacaacaacaagaaattagttttgctaaaaacacttttacagaaaaattaatcgaacatttaggcatcattgaagtgcaaggacctatcttaagtcaagtgggaaatggtattcaagataatctttcaggtacagagaaagcggttcaagtaaatgtgaaacagatcactgatgccaaatttgaagtggtgcattcattggcaaaatggaaacgtcatacattagctcgttttaactttgcagagaatgaaggcttatttgtacatatgaaagcattacgtcccgatgaagatagtctggatcaaacccactctgtttatgttgatcaatgggattgggaaaaagttattccaacaggacgtcgcaaccttgcttatttaaaagaaactgtacgttcaatttatcaagctattttggaaacggaagatgcagtacaccaaaaatttgggttgagtaaatttttacctagagagattacttttatacacagtgaggaacttgttcaacgttatcctgaattgaacgataaacaacgtgaaaatgcgatttgtaaagaatatggtgcagtattcttaatgggaattgggggagtattatcagatggcaaaccacatgataagcgtgcacctgattatgatgactggacaacaccgtctgaaggtgagtatttaggtttgaatggtgatattcttgtttggaatcctgtattggagcgtgcatttgaagtatcttctatgggcattcgtgtagatgaaaccgcattacgtaaacaactggcattaaccggtgatgaagatcggttgcaatttgactggcatcaagatcttgttaacggacgtttaccgctttctattggtggtgggattggtcaatctcgcttggcgatgttgcttttacagaaaaaacatattggcgaagtgcaatcaagtgtttggccaaaagttgttacagaacagtttgaaaacattctgtagtgtgcttttgaatattatattgaaaaagtgcggtaaaaataccgcacttttttatattaacgctggtgtattcttgatagaatgagcactcacttatgcttaataaaatataatttatgtataactcattttcttctttatttgaacaagttttgcagtctcccgattttatcattttaataaagatgtctgttgctatgctattgggtggagcaattggcttggaacgggaattgaagcataaaccggttggtgtaaaaacttgtgtgattattgcggttacaacttgtattctgaccattgtgtcaattaaagctgcggaacattatgcacaagtttcagaaaatatccgaacggatccaatgcggttagcggcacaagtcattagtggcatcgggtttctaggtgcgggggtaattttacgtaaaagtaacgatgctatttcaggattgacaactgctgctattatttgggcagctgctggtattggtattgttgctggagccggcttcttttttgatgcttcagttgctacatttatgattttaatcgcagttcgggtaggtccgacgttacaacaaattatccgtcgcagtacacgtagaacacgtaaaactaaaatttatattcaacttagttcaccattgatcatcagtaacgttacggatattttaattaataataattaccgaattgatagtttatctgtcaaagatttacaaaatggagaagtgcgtttaaccattagaggattaatcacagataaatcgaaagtacaaggcgtttatttgttactaaaagatgaagaaggcgttgtcagtattgatttggctaattaaaagaaaaatccagatatttaattgatttgctccaaaagttgtactacatacaccatcaacaaattaaggggcagattttttatgatcaaagggaatatctccttaaaaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgactcaacattaccttctttccagcaaagcccgcacgcttcgtcattacagatagcccgcctatctgatgaacaagcgtttgcgatgctgtgtgaaattcgttggggaagtcaggaaaatgtgtgttgcccgaaatgtggtgtacaacatcaagcctatttcatctctactcgcaaacaatggcgatgcaaacattgtaaacacacctttagcattacatcaggcacgatttttgcgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctttgtgcaactgctacataataccnaaattttatccttttcacttgagctttatttttaatctctgtataatcgccaaccttacagccacagttaattttcgttccttgcttccgcaagattggtggctgatcttataatcggaggctgattaacccgtaaggagcagtaatgcgtcactacgaaatcgtatttatggttcatccggaccaaagcgaacaagtacccggcatgattgaacgttatacaggttctgttaaagaagctggcggtcaaatccatcgcctagaagattggggtcgtcgccaattagcgtacccaatcaataaattacacaaagcacattatgtgctaatgaatgtagaagcgcctcaagaagtcatcgacgagctagaaacaactttccgttacaacgacgcagttcttcgtaacgtaattattcgtactaagcacgccgtaacagaagcgtccccaatggttaaagcacgtgaagagcgtaagcctttaactgaagttgaaaacaacgattttgaggatgctgaagagtaatttagaggttgataatcgtttttcgttaattggcaaagttgctgattttccaaaacgaaacaaaagcccaagtggaattgatcattgccttttctatttggaacatcgttcaaataaaaaagaggcaggttttacccgtcaagcatggtgtaaaatagccatccaaattagtggcaatcaattaatagagaaaactcaaagcattacggtcggtcagcaattattagttgtaggttttgttacttcgcatagaagttcaaatggtttaaatcaattagtattgcatgccgagcaaatcgaatttatagagtaggagactagccaaatggcacgttatttccgtcgtcgtaagttctgccgttttacagcggagaatgtggtagaaatcgattataaagatattgctacattaaagaactatatcacagagagcggcaaaattgttccaagccgtattaccggtactcgtgcgaagtatcaacgtcaattagctcgtgcaatcaaacgtgctcgctatttagcgttacttccatacactgacaatcatcagtaatttaaggagaatacggtaatgcaagtaattcttttagataaaattgctcatctcggtaacgtaggtgatcaagttagcgttaaagcaggttttgctcgtaacttcttaattccacaaggtaaagcagttatggcaactcaagctaatattgaatattttgaaagtcgtcgtgctgaattagaacgtaaagcagcagaagttctagctacagcacaagctcgtgctaatcagttagcagaattggcaactgttactattacatctaaagccggtgatgaaggtcgtttattcggttctatcaccgcacgtgatgttgctgaagcagtaactgcggcaggtgttgaaatcgctaaaagtgaagttcgcctttcaacaggaccacttcgcacaaccggcgaacaccaagtccgtttccaattacacggcgaagtatttgcaacattaaatgttgttattgttgcagagtaatcattaaaattataatgacagaacccaacttttatgttgggtttttttatatctttgttgccccaagtaatcttatagctaaattctttaactcatacattaatccacgtatttttctaacataacattattcatttctattttttatcctttatcctttatcctttatcctttgacaaccttagtagctttaattcaattataataacgcgctgttttcttactaactctttgagaaatagtaatctccgataattcctgtaatgatcatgggcttattgtaatctctgctattgtgtatgggatattttaaaatctaaataatccgatacggtgtgccgtttcttttttgggtataatctgtcaatcttcttttactaaaggagattattgatgagtaaatcaaaagtaatattaatccgatatatattgtgctacaataagtgcggtgcatggtgcatggtgcatggtgcatggtgcatggtgcatggtgcatgcttcgatataatatattttgagtgaggaatttgcgatgtcctatttagaacgtgcaagagagctttttgatgaagcaaaagcagtgagaagacaaatccatcaacaccctgaagtgggttttgagttgcccgataccatggcgttgattaagaaaaaattggatgaacataatattcagtatcgtcaattggacgatgcctatgctctagtggggacgttgggcgatccgagcaagggtaagacgttgttgttgcgtgcggatatggacggcttgccgatggtcgaagaagcgaatttggaatttgccgccaaaaatcaatgtgcacatttgtgcggtcatgatattcatgcgacaagtttattggttgccctgatcatgctcaaagaagatgaagataagttgcaagggcaaatcaaatttttattccaacctgccgaagaaacgctgaatggtggcaagttgatgatcgaaaaaggggtgttggaaaacccaaaaccggatgctggtctagcactccatatgtggcctaatggtgaaaaaccagggattttgataaataaagaagctgcattggcatctgcattgaattttaaaatcgagattaagggcaaaggggcacacggtgcgatgccttataacggtgtcgatcctgtgtttgtggcttcgcaaattattaacggtgccaacggtattttggcacgtgagttgccttccagcaaaggggcttctttatccataggatcgatcagtgcaccgggcggggcaatcaatattgtgcctcctaatgcgtatttggaaggaacttcccgctcgttatacgatgattcggctaaacacatggcaaaacgattgcctgaaattgtcgagcatatcggtaaggcattcagagccgagacagtctatgaggaagtagcgaatgtgcctgcgttggtcaatacgcctaccatgtctgagttggtcaaagcttctgccgaagaagccttgggcccggaatatacggtgaaatatattgatcctcttttagcttccgaagactatgcccatatcgccagtcaattgcctgaatcctgctatttctttgtgtcttgcccgcaaccggatgcggacggcaatgtctatgcggtacaccaccctaaagtggtcttcaatgaagaggcattgattatcggccctgcaactatggcacaagctgcggtgaactggttagcaagtcatcgttaagtgagtgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttgcgcccatttgccagcttgcgtcctttgcatgaaatgctggatttttcgcgcacggtgtttgataaagccattcagacggcattggtggagaaggtggaaattcggagtaagtatccattggaaatcattggtaaaattgcgccacatattgaaagcggaaaacgtcctagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgaactagtcaaattaagaaaaaaacggcaaccctacctcatttcttcctgaaagtgcggtgtttttttgcgataaaaatcattttgttgattaaaaacttttcatgaagacaaaatatgtgattttttaaatgaaaaaattgctatttacaatgctgtttattgaatcaaatggttacagatcaatgctatcgttttttttgtttttgaatgtgaaataatgaagcgataatttgatttaatttatgtattgttatttaatatgcctatccgttggtaacggcgattattttattaagcatgacattacgcttgctgtctacactgtcaataaaacacgtttatgtgatggtctggggagtattttatgtcttgtttttgtgtgttgttgtaatctgtatatgagttttttttggagtatctataatggaaccatcctaccaggaacaaaacaattgtactgaaacgattaaaatcaatgaagtcaaaaaactttggttggacagtaaattttcccttaatttacctgtatggacattgttgttgcctttatttgcattattagtattggcatttcatttgctgactcacccaacaggctggttgattaatactgttactacggttttgcttatcggttcggtatttgctgcagtgcattatgctgaagtgattgctcataaggtgggggagccgtttggtacgttggtgcttgcaatagcggtaaccgttattgaagtggcattaattgtgatcctgatgagtaacagcacgcaggaaaattctttggtgttggcaagagatacagtttatgcggcattaatgttgatttgtaatgggatcgtgggtatcgggctgctgataggcggtatgaaaaattatgtccaattatttagcttgcacggtattaaggctgctgtcagtgttttactggcaatttcattaattgtttttgtgttgcctaattttacgctttctgccgagggtggtggaatggtcaattcacagctgttgttcgtggcaatgtgctgtttggtactttacggctctttcatttttacgcaaactattcgccatcgtaattattttgttgatgaggatgaaaatgaaagccatcacaacgacaattggttaacaattggtgtgagtattgtgtttttattgataagtttagtttctgtggtaggactggctaaaatgctatcgcctactattgagtctgcactagttagtttcggattgcctaaaataatgttggggattatcgttgccggtttggtattgttgccggaatcaattgcttcaattaaggctgcctataataaccagttgcaaaacagtctgaatcttggtttgggttcggcattagcgtctatcgctttaactgtgcctgtgattgcgattatttctgttatctccggtcagcctattgtgtttggtttaacagccaaagaaagtttgatgctgattattacacttttattgacaatgaatactttaagcacaggacgtagcaactttttgttgggagttattcatttggtaatgttagcaacttttattttcttttccatcattccttgattttgaaatgaatgatttacatcagtaagtacgaagagaaaatcaatcacattattatcgggcagaaatatatgaaaaatagaaatttttattttggattgggttttattgctttgcttaccattatcgtgagttggttggcaaatactcaatttgcacatcaagcgaaaatcagtgctttgactatcgcaattttgttaggcattgtaattggtaataccttttatcccgcactttcatcaaaactggacaaaggcgtgttatttgccaagggaacattgctacgtattggaattatattatatggcttccgtttgactttgcaggacattagccatgtgggaatcaatgccattgttacagacagtgttatgttgctttccacttttttccttgctattgggataggaatttattggcttaaaatggacaagcagacggtgtatttgacggctggaggctgtagcatttgtggggcggcggctgtgatggcaatggaacctgttaccaaagccgaatctcataaagtatccgttgctgttgcggtcgttgttatttttggcacgattgccatgtttctatatccgtttgcctattcttatttacaacattggctaacagatcatcaatttgggatttatatcggttcaacggtacatgaagtagcacaagtttatgctgccggcggtaatattggtcctacggttgctgatacagcagtaatcaccaaaatgattagagtaatgatgttagcgccatttttattagttttatcttgggcattatcaaaacagaaatcagataaaagtaaaattaatattccttggtttgctttcttatttattctcatggcaatctttaattcttttgatattttgccaaaaagtgcggttaaatttatcgtagtcttagacgatttactgttaattgccgcaatgatagctttagggttgacaacgcatattagtgctatcaagaaagcgggagtaaaacctttattattagggatgttactctttatttggttggttttaggaggattagcagtgaatttggtaatgcaaggatttttataaagataaggatattattttgaacaatcttactgaaacgtttactctcgaacctcaagataatgcacgcttacaatccctttgtggcacatttgatgagcatttgcaattaattgaaagcagttttaatttggttgtttcacgccgtaattttacttttactgtacaatccgcagacgaagaagaaaaaaacacgtaccatccaactttgctaaaaagtgcggtgaaattaattaaaaatttatatgctgacactgcaaaaattcgtggcaaagtgaaagagctggatttggaagatatacatttggcaattcaagagagccgaatgttattacaaaataatactcaaacaaagcgggaagatagtaaagtttatagcacaacgattaaaactaaacgtggcttaattaaacctcgtggcagaaaccaaattgaatatttacataatattctcactcacgatattagttttggtattggaccggctggaacagggaaaacttttttagccgttgccgcagcggttgaagcattagagcgtcaagaagtgcgtcgtattttgcttatacgtcctgctgttgaagccggtgaaaaattgggttttttacccggtgatttaggacagaaaattgaaccttatttacgtccgctttatgatgctttatttgaaatgttagggtttgagcgtgtgcaaaaattaatagaacgtaatgtaattgaaattgcaccgttagcttatatgcggggacgaacgttaaacgacagttttattattttagatgaaagtcaaaacacaacggttgaacaaatgaaaatgtttttaacccgaattggatttaattctaaggctgttgtaaccggtgatgttacgcaaattgacttaccccgtagtcaaaaatccggtcttcgccatgcgattgaagtattagaaaatgtgccagaattaagttttaactattttgacagcaaagatattgtacgtcatcctgttgtggcaaaagttgttcaagcttatgaggtttgggaaattaaagatgagtttcgtcgccaacaattagccgagcaaaaacaacaagagcggttagaaaaagagcagtttaccgaagaacgggtaaaagcgttacaagaataattttatacaaaggttcaattcatgaaaaatgtcattattgacctacagatagcgagcgaagatgcgaccaatttaccaagtgtggaacaaattcaactatgggcaaatgcggcaattcgagcggaaaacttacaacctgaaatgacagtacgcattgttgatgaagaagaaagtcaccatttgaatttaacctatcgtggtaaagataagccgactaatgtgctttcttttccttttgaatgtcctgatgaaattgaattaccattaattggtgatctagtgatttgtcgtcaagtagtagaacgagaggcgacagagcaagaaaaaccactaatggcacattgggcacatatgatcgtacatggtagtttgcatttgttaggttatgatcatattgaagatgatgaggcggaagaaatggaaaggttagaaacggaaattatgctttcgttaggttttactgatccttatattattgagaaataaccaacctgaaatgatatctcctcgccatgtgcaaattagtattgcacccaatctgcaagattttggaccgcactttttatcacattttgatgttttgtggttagggtgggaaaaacctgattttaatgtgcatttttgccatgtgcaaaaagcaaaaaagttacttgggcaagagtttttaaatgtgatttttgatgctcgtcagggatttcatttagaaagtttagcgattgtggcaggaacagtaaaagcgggtggaacattaaatattctacttaatcattgggatcttttagaacaacaagctgatattgatagtttgcgttggagcggtgtagaaggaatgattgcaacaccgcactttattcagcattttcaacgaattgttgaccaatttcagtttcctattaatcatttcacgattccggcgattaccccaaataatctacctgatttattttgctcagttcaattgagggcaactaaagcacagcaaaaaattattgacagtattttacagcaacaggcagatatttattttttaacagcaaaacgtggacgaggcaaatcagcattattgggtttgttatctcaacaagtaaaacagaaagtttatttgacggcaccgaataaaagtgcggtggatattttgcaaaaatttgccggtcaatccgttacttttattgcacctgatgagtttgttcaccgtttggtagaaaatccgcaagaatatcaacatgcttggctatttgtagatgaagcagccatgctacctgtcagtaccttaaatttttttagtgcttattttaaacatattgtttttagtacaaccattcatagttacgaaggtacagggcgtggttttggcttaaaatttaagcaacgaattttacaacaacggcgaaaatgtcttgaatttgaattaaaggagccattgcgttggcgtgaggatgacaagttagaaccttttattgatgtgcttttattgcttaatagcgaagatgattttcggcaatatcattacaaatccaatttggacgttcacataaaatcgctaaatcaacaggcgttattgacacaaatagcagatttttacggtctattgtctttagcacattaccgcacttctcctattgatttacgtcgtttattggatgctccaaaacaacgattttatttggcacagacagaaggacatttgcttggtggggtatgggcattagaggaagggggattgtcggatcgaggattgattgcgggaatttgtcgaggagaacgccgtccgaaaggtaatttaggtgcacaattattggcttttcaatatcttaattcacaggcttgtgaattacgttctttacgaatttctcgcattgcacttcaacctaattggcagagaaggggagtagggcgagatttgatagctgctttgaaagtagaaagtaacattgattttttatcagtgagctttggttacagctcggagttggtttctttttggcataagtgcggttttaatttagtgtatttgagtgagtataaagaaagtagcagtggcacatataatgcaatggctatttgtcctttgactttgcgaggcaaagaattttcacaacaatgtatgagtcaattcagacgagattttgttttatcggatcatcctttattgaatgagattataaataatcaaactattgaggtagagttaaatgcctttgatgtatactcattgcaaaaatttgcattttattaccgcactttatcggctgctcgtcctgccttatggagactattgaagatgatagctccctctgaatgtcctgtcttgaggaaatatttttgtggtgaaaaagatttcttgtcttatggcggttatcgacaaggagtgataatttgtcgcaacgaagtaaaagaagtgttgcaaaaatataaaaactttctatgatggagtgatttttatacaggaaggagaatgtgatgccggatcaatcagaaaagaaaggttttttccgccgtatgctggatgcgtacaatcaattttgtaatgaaatggaggtggataaagggacttgtcgaggctgtgtacctatagtcaaatttgatgaaaatgcaaaacaagaaacagataatgaggctggtaaagcatcataattgtgaagtacttcacataatggaaaagatttagccaaccaatgtatccatcttagtttacttaactataacaactctctaaaatacgcacgctttacttcagtgaagttggcgtatttttattattatttttaggtgattattatgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccaattttcggaccgattatgggggcattatatggaccggtggcgatgttatggattgtactgggttgtgtatttgccggtgcagtacatgattatttctgtggtatgttgagcgttcgtaatggcggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtacggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattgggcgtatttatccattatttggtggactattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggttacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcgtttattagtgcggtatgttttacatacttagcctataacaaaatcggttttggtttagattatcaactttccgtttatattggtattggattaactattttgtgtttagtggctttctttactttattgaaaccgttaggttcgaaagatccggatgcctttataaatgatgtagcataatttataaacaatagataaaaaaccgtttaaggcaacttgaacggtttttttataaaaaatttactttatttatatgttttcaagataaaaaacttgcaacctaatctcactggtaatacacttatgaagtggtaaaaagtggaattttgtggagaaatttgtcacaatcttcctcatttatctgcgatgaataattttttgtgattaaagtaaggaaacaatatgtttcgaggggcatcagcggttaatcttgattctaaggggaggattgcaattcctactcgctatcgtccggaaatcctcgaaataaatcaggggcagatggtttgtaccgttgatattcgccagccttgcttattactttaccctttaaaccaatgggaaattattgagcataaattatcaaaattgtcgaatttcaatccggaagaacgtagtttacaacgagtaatgctaggttatgcaactgaatgtgaacttgacagtgccggacgaattcttattagtgctcctttacgtcaacatgcaaaattagaaaaatccattatgttggtggggcaattaaataaatttgaaatttggagcgagtcagagtggcaagctcaaattgaaaaagatatgacattaggtgcgagtggacaatttgccatgtctgaagcattaagtatgttatccctataataaaaaagatacgttacagtcagtaacggtactagcaaaggtaaaaaggtacgttttttgttgtaccttttatcccttttgattttattgatttttcctaggttattgcaaatgagtatgcaagatacattttcttcacctgagcatttcactgttttattaagagaagcagttggcggtttagccttaaaagaaaatggtatctatattgatgggactttcggtcgaggcggtcattctcgttttatcctttctcaactgtcaaaaaagggtcaattaattgcgattgatcgtgatccccaagcaattcaggttgcacaaaatattcaagatccacgttttcgtattgtgcatgacagcttttcagctattccggatatttgtgaaaaattaggattgacgggcaaaattgatgggattttacttgatcttggcgtgtcatctccgcaacttgataatgcggaaaggggattcagtttcatgaaagatggtcctttggatatgcgtatggatacgacacaaggattatcggcaacggaatggttgaggctggtttctgaacaggatttagcatgggtattgaaaactttcggtgaagaacgctttgccaaacgtatagctcaggcgattgtaggatataacaaaagtgcggtgcaaagtggagcagaacctttaaacagaactttacaattagctgaactgattgctcagtctgtaccttttaaagataagtataagcatcctgcaacgagaagtttccaagctattcgtatttttattaattccgaattagatgaattagaaaaagtattgaatggagctttaaatgttctcgctcctcaaggacgtctgtcgattatcagctttcattctctagaagatcgtatggtaaagcattttatacgtaagcaaagtaaaggtgatgatttgcccaaaggattgccattgcgtgaagagcaaattcaacataatcaaaaattaaaacctgttggtaaagcgattatgccgacagaacaagaaatggctgctaatgtccgttcaagaagtgcggtcttacgcattgcggagagaatataatggtaagagatttcgaacgctacccattgtataaagttatttttgaggacttggtttctgcaaataaattattaattgttttaacgattttggttgtattgagtgcgttaagtacagtttggattactcatcaaactcgtattttagtcgctaaaaaaagtaatttagttgttgaaaatcaatcacttgagcaagaatatttaaatttaagattagaggaaaaggcccatagtcttcattccgatatagagtcttttgccactcaaaagttgaagatgaaatccgttccggctgaacaagaggttgttatcattgaatagataatagatattaggcggttattaatgacacataataagataaatcgaaaaaataaacgagcatttgaaaatggtgcaaagcgtaatcaacctaaaaagatctatgaaaatagtttcttgaaatggcgttttatggttgttgttggtcttattattttatcactcacagctttagtgggacgtgctacttatgtacagatgattaaatccgatgtgctatctaatgaggcggatgaacgatccttgcgtaaagaaaaaattttgtctatgcgaggtaccattgttgatcgcaatgggcaacttttatcagtgagtgttcctatgttttcaatttcagctgaaccaaaaaaaatttttagtaaaaatggtttacaagatgaggaacgctggagtgcattagctaaagcattaggtatgtcttacaaggacttacgaaaaattctagaaaaaaatcctaaatctggttttgtctatttagctcgtcaggtgtcaccaaccattgcggagtatgttaaagaattaaatctatatggagttaacttaaaaactgaacctcgtcgtttttatcctaagacagaggaaactgcacatttactcggctataccaatatagacggggaaggtattgaggggatagagaaaagttttaattcatttttagttggtaaacctggatcaagaacagttcgcaaggataggtatggtaggattattgagaatatatcagatcttaagaaatacgatccgcaaaatgtcattttaagtattgatgaaaaattacagtccgtagcttatcgtgaaataaagaaagctgttgaaaaatacaaggcggaatcaggaacggcagtacttgttgatattcatacgggagaagtgttggctatggctaatgcaccttcttataatccaaatatacgcacaagttttaagactgaagtgatgcgtaatagagctattacagatactttcgagccaggttcgactattaaaccttttgttattctgaccgcacttgaaaaaaaagtagtgcgaagagatgagataatcgacactggtcgtttggttttagatggatatgaagttaaagatgttgcagtcagagatcgtcaaacgcttgatcaaattttagaaaattcgagtaatagaggggtgagccgtttggctttgcgtatgcctgcaaatgcactaatagatacatataaaaaagcaggtttagggcaacgaacagaattaggtttagttggggaaccggcaggtttcttgaatgccgatcgtaagaaatggccagatattgatagagccagtgtttcctttggttatggcatcagcactacgccgttacaacttgctcgtgcctatgttactttgggcagtttcggtatttatagacctctttcaattacaaaagtagatcctcctgttattgggcagcgagtgttttctgaaaaaatgactcgtgaagtggttaatatgatggagaaagttgcgataaaaaataaaagagcaatggtagagggttatcgagtgggaataaaaacaggaacagtaaagaaaattgaaaatgggaaatatgttaacaaatatattgcttatacagccggacttgctccaatcagcaaccctcgctatgccttagtggtattaattaatgatcctaaaggtagagaatattatggtggggatgtttctgcccctgtattttccaatattatgagttatgctttgaaagcaaataatattcctcctgatagtagtaactatacaaaaactgttagacgtacagtttatctcaatagtcaagagaataaagcgaaagccaattaatcattcaggtaatctatgaaaaaattaaccgcactttgggatattgatgaacaattagatagcgttcatagagatattgaacttcaagaaatgattttagacagccgtttagccaagaccggctgtctttttgttgcgattaaaggacatcgtgttgacggtcgagaatttattatgcaagccattcaaaatggagcaagtgcggtgctgtttgaaactgatctagtggagcagcatttgaaagtaagctttgagcaaaatattccgcttattgcgtattatgaactgtcaaaacatctttctcatattgcagatagattttattcatctccttcacaacgtttaacccttgttggtgtaacgggaaccaatggtaaaacaaccatagctcagttacttgcacagtggacacaaattttagggcatacaagtgcggtcatggggacgattggcaatggtttatttggacaaataaaagaagcttcaaatacaacgggatcggcaatagaaatacaatcctcgttagataaatttattcggcaaggtgctgattttgctgcgattgaagtgtcttctcacgggttagtgcagcatagagttgaggcactgacttttcgtgcaggcatttttaccaacctaagccgtgatcatcttgattatcatcataccatggaaaattacgcacaagcgaagaaacgtttgtttagtgaactgaattgtcaacataaaattttaaatgttgatgatgaaatcggggcaaaatggctgattgaattaagtaaagaggatcctgatgtggttgcagtaagttgccgtgcggattatcaaccaagcacgaaaaattggttaaaagcgaccgcacttagccctcatagtaaaggcacaacgattgagtttgtctcaagttggggaaatgggatcttaagtagcccattaattgggggcttcaatgtgagtaatttattacttgttttagccacactcttatcgcttgggtatgacatagataaattacttgctacagtacggcaattaaccggtgtttgcgggcgaatggaaatgttgagtgcaaaacataaggctaccgtgattgttgattatgcacatacaccggacgctttagagaacgctttgcaatctgctgcagttcattgtcagggaaaactttggtgtattttcggttgtggcggtgatcgtgatagaggtaaacgtccattaatggcagctattgccgaaaaatttgctgatagtgtgattgttactgatgataatcctcgaacagagaatcctgaacaaattatgcaagatattttgacaggttttcagcaatcaagtgcggtgcagattattcatcagcgtgagcaagcaattaaaacagcgttacaacgtgcggtagaaaatgatgttgttttgattgctggaaaaggtcatgagaattatcaaattattggaacaactaaataccatttttcggatcaggaaattgtaaaaaagtatttttaagtttagtaaaatttgaagtcattgatgagtaaaatacagaaataattcattgtattgaatgatgagaagtaagaaataacatgattaagttatcgacaaaagaactggctgacattttttccgcacgattaattggagcgaaggatatttgtgtggaaaaggttagtaccgacacaagaaagccttgtttaagaagtttgttctttgctttgaaaggtgaaaattttgatgctcatgattatctgacacaggcagtagaacaaggttgttcagctgttgtagttgagcgtgagtgtgatgttgatgtaccacagttaattgtacctgatactcgtcttgctttagggcaattagctaaatggctaagagtaaaaattaatccaaaaacaatcgcaataacgggatcttccggcaaaacaactgtcaaagaaatgacagcttctattttgcaaaaagtggcacaagatcctgatgcggtcttatttactcagggcaattttaataatgatatcggtgtgcctttgaccttgttacgtcttgagtcgaagcataagtttgctgttattgagttaggtgcaaatcatcaaggtgaaattgcttataccgtggatttagttcaaccggacgtggcattggttaataatgttgctgcggctcacttagagggatttggaagtgttgaaggggtggcacaggcaaaaggcgaaatctatcaagggttaagtgaaaacggcattgccataatggaatatgagcattctgtgctctggaaaaagtattggtatgaacaaataggtaatgcagatactcgattgttttccgttatggggatggtgtcggattactatgcacaagaaatcaaattaacggaaacaggcagtcagtttacattgtgttgcaccgggcaaggagaaattaagattaatctgccttatttaggattacataatgtcagtaatgccgtagcggcagcctcattagctttatgcttaggtgtgagtttagaacaaatcaaagcaggcttagaaaaaaaatcgtatgtaaaagggcgtttatttcccattgagccttgtccaaatctactgttattagatgatacttataatgctaatgtaagttcattgaaatccgctattgatgtattgcgacaatatgataaatttttccgtatttttgctgtcggtgatatggcggaattggggggaaattcagtgagttgtcacaaacaagtagcggattttgctcagatggcgaacttagatttagtggtcagttttggtacacaaagtgcggtcatttccggtgcttgtgatggcgttcattttagtgataaaaccgagttagtgaattatataatccccattattcagcaaaaattagccagtcaaaaagttgttttattagtcaaaggagcgagatgtatgcaaatggaagatgtgattaatttagtaaaggataaatttcaatgttagtgtggttagctgaatatttacaccaatatcaaagtgtatttaatgttttttcttacttgacagtgcgtgcaattcttgcacttttcaccgcacttttactctcgctatggattggtcctaaagtgattcgtcgtttacaaattttgaaatttgggcaagaaatacgtaatgatggtcctgatagtcacttaagcaaaaaaggcaccccaacgatgggcggtattatgattttatttgctataggggtcagtacgttattatgggcaaatttagccaatccttatgtttggttttgcttgtttgtattatttggctatggagcggtcggttttgttgatgattatcgtaaaattacacgcaaaaatactgccggtttagttgctcgttggaaatatttttggctttctgttatcgctttaatctctgctttcggtatgtatgcgataggtaaagatacggatgcgacacggttggttgtgcctttttttaaagatgtcatgcctcagttaggtttgttttatattgtattggcatattttgttattgtgggcaccggcaatgcggttaatttgaccgatgggctggatggcttggctattatgccgacagtttttgttgctgctgcatttgcgttgattgcatgggcgaccggaaatattgaatggtcaaaatatttatatattccctatattaaacatacctctgaattggttatattttgtactgcaattgtgggtgccggtttgggttttttatggttcaatacgtatcctgcacagctttttatgggggatgttggttcattagcattgggtggagtattaggtactattgccgttttagttcgacaagaatttttattggtgattatgggcggtgtatttgtcgttgaaactttatcggttattttgcaagtaggatcttataagttacgcaatggtaaacgtattttccgaatggcaccaatccatcaccattatgagctgaaaggttggccggaaccacgagtaattatccgcttttggattatttcgctgatgttagtgttacttggattaattaccttgaaattacgttaaggcaagctatgactaatcaatatcaaaacaaaaatatctgcgtagtcggattaggtaaaacaggattgtcttgcgttgatttcttgttacggcagcaagcaaatgtacgtgtcattgatactcgtcaacagccgacgggagcagaaaaattacctgaaaatgtccccttacatacaggaagcttaaaccaacaatggctacttgaagctgatctcattgtgattagccctgggctttctgttaaaacacttgaaattcagaccgcacttcaggccggtgtagaggttgtcggtgatattgaattattttgtcgttacgccaataagccaattattgctattacaggctcaaatggtaagagtaccgtgactacattggtcagtgaaatggcgaaagaggatggcttaaaagttggaatggggggaaatattggtattcctgcccttgagttattgcaacaagattatgatctctatgttttagagctatcaagttttcaactggagacgacttatagtttgaaagcgacagccgcaacgattttaaatattagtgaagatcatatggatcgttatctcgatattgaagattatcgccaagccaaattgagaatttatgaaaattgtcaacgtgcggtaataaatgccgaagatgtattaacaacaacggaagatttaaagtctccaattacttttggagaaagtcaggctgattattggctaaaaacggaaaatggtaagcaatatttaatggcaaaagagcggttaattttaccttgtgatgaaatgaaattggtaggtcgtcataattatatgaatgcgttggcggccagtgcgttggttcaggctgtcgacataagttttactgcaattcggaccgcacttcgtaaatttaccggtttagctcatcgctttcagttagcatatcagaaagatgatgtacgttggattaatgattcgaaggcaaccaatgttggaagtacagttgctgcactgaccggtttgtatgtagctaataaattacatttattgttggggggggatggtaaatccgcagatttttcggaattggcaacattaattaatcaaccccatatttattgctattgttttgggcaagatggtaaagaacttgccgcactatcagtgcaaagtcagttatttgatacgatggaacaggcaatagaagctattcgtccgaatttacagcaaggtgatatggtgcttttatcaccggcttgtgcaagtttggatcaatttaaatcctttgaacatcgaggtgatgtttttagtgatttagcgaagttggcacagggttaaagatagagacaaaatgggacaaaataacgtaaaacaacatattgatcgttggttgcgtattacaccaacaacagcattatatgatcgagcattgctatggttgtttattattctattgtgcttgggattaattagtgtatcttccgcatctattccaatcagtacaagattatttaatgaacctttttactttataaaacgtgatataggatatatttttatctcgttaattgcttttgcgtttgttgttctcataccaatgagaatgtggcaaaaatataacgttatattattttggattgctgtgattttattattgctggtgcttactggaatcggaaaagatgcaaacggtgcaaaacgttggattccgttacaactatttaattttcaaccagctgaatttgccaaattagcactaacgtgttatttggcagattatttcacacgccgttataatgatgtacgtagcaaaaaattaagtgcatttaagccattttttgtcatggctatattgggtggattattattgttacagcctgatttagggagtgcggttgttttatttgttataacttttggcttgctttttattgtcggtgcaaatttttggcagtttgtagggttgggaggaatcgcttttttcttattcctatggttagtcgcatctgcctcttatcgtttaaaacgctttacaggttttcttgagccttttaaagatcctctaggagcaggttaccaattaacaaattctttaatggcttttgggcgaggtgagttatggggcgaaggattgggaaactctgtacaaaaattggaatatttgcctgaggcacataccgattttgtcatggcgattgtcggtgaggaatttgggcttgtgggcattattgtggtggtgttcttacttgcgttactcgtttttagagtaatgaaaatagggagagagtcattattattagaagaacgctttaaagggtttttggcttttggtataggtttttggatattttttcaaggatttgtaaatctcggtatggcattaggcatgttaccgaccaaaggattaacctttccattagtgagttatggcggttcaagcttgctgattatgtcagtcagtattgcaattttgttgcggatagattacgaaaatagagttgttcgagttggaagtgctcgactaagagatgattaaaataaggaaaataccgtgtcaaaaagaaaaaaattattggttatggctggcggaaccggaggtcatgttttccctgctattgctgttgcacaatatttacaaaagcaagattgggatatttgttggttaggcactcgggaccgtatggaagcaaagttggtgccaaagcacgggattccaattgagtttattcagatttccggtttaagaggcaagggattaataactttattgaaagcaccttttgtcattttaagagcggttctacaagcgagaaaaatcataaagaaatatcaaccggatgtagtactcggcatgggaggatatgtctctggaccaggtggagttgccgcaaaactttgtaacatacctgtagttgtgcatgaacaaaatgctgtattaggtttaacgaattcattgctggctaaaattgcgacacgggtattacaagcatttccaaatacatttcctaacgcagaagttgttggtaatccggtgcgtgaggcgtttttttctgtgcctatgccacaagaacgttttgatactgcttgtgagacactcaaagttttagtggttggaggaagtcaaggggctcatatattgaatacaatattaccggaagtattagctcaattgcctaatcgtctggaaattgttcaccaagtcggggctggttcggtggaaaacgtcaccgcactttatcatgataaagttaatcttacgcaagaatcagtacaaattaccgaatttattgatgatatagctcaggcttatgcttgggcggatatcgtcatctgccgttccggagcattgactgtctgtgaacttgcagctgttggtacaccggctatttttgtaccctttcaacataaagataaacaacaatatttaaatgcaaaatatttagctgatgttggagctgcctatattgttgaacaacatgaattggatgcagaaaaaatagctcaattattaaaaaatgtagataaagaaaaattactggaaatggcggaaaaagcaaaaaatatgtcgacgccgttatccactcaacgtgttgctgaagttataatggatactgttaaaacttagccaattaaaatgaaaagaacattttgctatgtaaatgaataaaggaatgatgaatgcaagcatttagacaacgaattagacaaactgtacctgaaatgcgtcgagtaaaacaaattcattttgttgggattggcggagccggtatgggaggaatagcggaagtgttattaaatgaaggttatcaagtaaccggttcagatattgcggaaagtgcggtaaccagtcgcttaatttctttgggagctaaaatttctttctctcatcatgcagaaaatatagagggtgctagcgttgtcgttgtttccagtgcgattaagggagataacattgaagttattacagcacatgaaaaacgtataccggttattcaacgtgcacaaatgctggcagaaattatgcgttttcgtcacggaattgctattgcgggaacacatggtaaaacgactactacagcaatggttgcaatgatttatgcacaagccggtttagatcctacttttgttaacggcggtttggttaagtctgctggaacaaatgcgtatttaggatgcagtcgttatttaattgcagaagcagatgaaagcgatgcgtcctttttacatttgcagccaatggtgtcggtagtgaccaatattgagcctgaacatatggaaacttatcatggcgattttgaagaaatgaaacaaacttatgtgaatttcttgcgtaatttgccgttttatgggttatctgtgatgtgtgctgatgatcccgttttaatggaattatcctctcaagtaggacgccaagtggttacttacgggttcagtgatgaggcggactatcgcatagaagattatcaacaaacgggttttcaggggcattatacggttgtagcaccgaatggggagcgtattgatgtgttgttaaatgtgccgggtaaacataatgctttaaatgcaaccgccgcattaaccgttgctaaagaagaaggaatcgaaaatgaggcgattctgaccgcacttgccgagtttcaaggtgccggtcgtcgttttgatcaattagggcaatttattcgtccaaatgggaaagtgatgttagttgatgattatggtcatcaccctactgaagttaacgtaaccattcaggcagctcgtcaaggctgggagaataaacgtattgttatgattttccaacctcatcgttattctcgtacccgagatttatttgatgattttgtacaggttttatcgcaagttgatgtgttaattatgctggatgtttatgcggcgggtgaacaggctatcgccggtgctgatagtcgctctttgtgtcgttcaatccgtaatttaggtaaagttgatccgattttagtctccgatcataagcaattagctgaaattgttgatcaggttattcaagatggtgatttaattttggcacaaggtgccggtaatgtgagtaaactttctcgtgaattagcgttagcttggagtaaagaatagtgattagcacttcggagttacaatgtaaaaaagcaggatataaaatgactaaaccattgaaacaacaaaaaatcgccgtcttattagggggaacttcagctgaacgtgaagtgtcgttaaactcaggaaatgcggtcttaacagcgttacgtaatcagggttttgatgctcacccaatcgatccaaaagaatatccagttgctatgttgaaagaacagggctttgatcgagttttcaatattttacatgggcgtggcggtgaagatggtacgatacaaggattattagagcaaataggcttaccctatacgggttgtggcgtgatggcatctgctttaacaatggataaaatgcggactaaaatgttgtggaaagcattcgggttacctgttgcagatatggaagtcgttactcgcactagtttttcgcagttaaatccgcaagtagttgtagaaaaattgggcttgcctttaatggttaaaccttctttggaaggttcaagtgtcggattgacaaaagttaacgctattgatgatctaaaaagtgcggtggaatttgcacttcaatatgatgaaaccgtactgattgaagaatggctttccggtgatgaattaacggttccgatattaggtaacgaagttttaccttcgattaaaattgtaccccaaggggaattttatgattatgaagcaaaatatattgccgataatacgcagtatttttgcccctcaggattaacggaagagcgtgaacaagagcttcgtcaattagtcaaacaagcttatgatgtcgtgggttgcaggggatggagccgtattgatgtcatgctggacggcgagggtaaattccgcttagtggaagtcaatacaaatccgggaatgacaagtcatagcttatttccaaaatcagctgcaactgttggttattctttcgagcaattggtcgtcaaaattttggagctaagtctttaaatgagaacaacgcataaagtaactgaaaatttgaaagtgacaaaacggaagtcctaccgatttgtcaacattaaatttattgttatgttgttattggttgcaatactgatttttattgttagtaatcgtcagtcgattttagaaaagttagatgatagctcaattaattcatttgctattgcaggtataacaaattttactgatgacaatgatgttcgtgaagttttgtctcgaatatcggacagcggtgagttaaaaggtttttttggacaagatattgatttggttaaacagcaaattgaaatgataccttgggttaaatcagtggcagtacgtaaaatttggcccaatcgcttaagtatttgggtaacggagcatttacccattgcacgttggaatgaaacagaatttttgtcatcagagggaataatatttcaattaccaattagcaaattaaaaatacaaggattacctcatttgtcaggacctgatcataaaagtgctgaggtactggaagcttggaataaaatttatcttgatttgaagagaaaaaatttgttgttaaaaaaaattgctatcaatgagcgtggttcatggcaaattgtgttagagaacgatgttgtattaaaattaggacgtggagaatggaaagataaattggatcgttttttcacagtttatccacagattgaaatacctgaaaataaaaagttatcttatgttgatttaagatatggtgttggtgctgctatcggtgtagtagattctgactaaatttaattttaaatatgtgaagtgactaaaatggctagaattgtagaagataagatatttgtaggtttagaagtaggaacctcaaaagttgttgctgtagtaggggaattattacccgatggcgttgtcaatgtattaggtgccggaagctgtccttctaaaggtattgataaggggagcattacagatttaaatgcggtcgtaacttctattcaacgagcaattgattcaaccgaagcggttgcagatagtcagatatttagtgtgacattggctattaccggtgagcatattcaaagtttgaatgaaaatggatttgtgcctattgctgaggaagaggtgactcaagaggaagttgaagcggcgttgcatacggcgagttcagtccgtattggagatgggctggcattattacatataattccccaagaatttgcagtggataagcaagtaaatataaaagatccactaggattgcaaggtgtgcgtttaagtgctcaagcacatttaattgcttgtcatcaagattggctaaataatctgaaaaaagcggttgaacgttgtaaattaaaagtgaacaaagttgtttattccggatatgcttcatctcaagcggtgttgactgaagatgaaaaagaattaggtgtttgcttaattgattttggtgccggtacgatggatattgtggtttataccaatggttttattcgctttagtaaggttattccttatgcgggtaatcgagtgactgacgatattgcttatgcttgtgcgacttctaggacagaggcggaaagtattaaagttgcttatggaagtgcggtcagtcctccattagatcctttagataaaaaaattgaagttgccagtatcggtgggagagcacctcgagttatcagcaaagaacaactttcaattattacttctgctaggtatgcggaattacttggtgtagttaaatctgaattggatcaattgaaatatcaattagaaagtaaacagataaaatttgaacttattgctggaattgttattactggtggcggagctcaaattgaaggattaagagaatgtgcaacgcaagtattcggttctcaagtgaggattggtgtcccacttaatattaccggtttaactgattatgtaaataaaccacaatattcaaccgtagttggtttattacatcatcataataatgattttgaggatattttatctgaaagtgaaacagaaactgacggtgtcggcaaaaaattttggaatatttgtaagaaagttgtcaataaagtgcggtcagaattttgaaaaattgattttttaatctacaataggcagaatttaagttttaattttgtgctaaagtcgggaattagcatttacggagaagaaatatgattgaaccggttgattacgattacgatgatattagcggaggtgcactcatcaaagtcgttggcgttggtggcggtggcggtaatgctgttaaccatatggtggctaatatgattcaaaacgatattggcgggacgctacttggcgttgatgaattggcttatccaatgtcagatgataatcatggcaaaattattttctatgctgtgaacactgatgctcaggctttgcgtaaaagtaatgtacaaaaaacagttcaaatcggtggtgaaacaacaaaaggcttaggtgcgggagctaatcctaatgtaggacgtaaggcagccgaggacgatcaggatgctattcgtgctatgttagaaggtgcagatatggtttttattgcagccggcatgggtggcggaacaggaacaggtgcagcacctattgttgcacaaattgcaaaagagctaggtattcttacggttgctgttgtcacaaaacctttctcttttgaaggtaaaaagcgtatgcattttgccgaattaggaatcaaagaattatctaaacatgtagattccctgattattattcctaatgaaaaattattaaaagtacttggcaaaaatatcagtttaattaatgcttttgctgccgcaaatgatatattgcgtaatgcggttactggaatatccgatatgattacttctccgggactaattaacgtggactttgctgatgtgcgtactgttatgtctgagatgggtcgtgcaatgatgggatccggtgttgttcaaggcacagcagctgatggtcgtgcagaaaaagcagcacaagaggctgttgccagtccgttgttggaagatgttgatttatccggtgctagaggtgttttagttaatgttactgcgggattcgatttaactttagatgagttttcaacagtaggtgagactatccgttcatttgcatctgaagaggctaccgtggtggttggtacaacgttggttcctgaaatgtcagatgaaattagggtaactattgttgcaacaggaattggggacattgaaagacaagatgttcagattatgtcaacatctccaatgaatgagcccgtaaaacctgttgaacagcagcatattcgtccagaacctagacatgatttagatacaccgattacagagagattaaaagcatttagacccgtagacccaacaagtttctctcgtgactaacagagttcatcttgttgtttagcaataaggttaaagaaagatgattaaacaaagaacattaaaacaaagtataaaagttaccggagttggcttacatagtgggaataaagtgacattaactttacgccctgcgatgccaaatacaggcgtaatatattgtcgaaccgatatgaacccgccggttacttttccggcaaatgcaaatgcggtacgtgatactatgctttgtacatgcttaatcaacgaggatggggttcggatctctacggttgagcatttgaacgctgctttagctggattaggtattgataatattattattgaggttgatgcacctgaaattccgattatggatggaagtgcgagtccatttatttatttgttattagatgctggtattgaagaacaaaatgtagcgaagaaatttattcgtgttaagaagccaattcgtatagaagacggtgataaatgggctgaatttaaaccttatgatggcttccgtttagatttcacaattgattttgaacatcctgcaattggtaaagatgtacgtaattatgtgatggatttttctgctcaagcttttgtacagcaaattagtcgtgcaagaactttcggttttatgaaagatattgaatacttacaatcccaaggtcttgctttaggtggaagtttagataacgctatcgttttagatgattatcgaattttaaatgaagacggtttacgctttaaagatgagttggttcgccacaaaatgcttgatgcgattggagatctttacatgtgcggttataatattatcggtgattttaaagcctataagtccggtcatggattgaataataagcttttgagagcattacttgaaaatcaagaagcgtgggaattcgtaagctttgaagataaagaagaaatcccgcaaggttatgtttctcctgcacaggtttttatctgaattagtgttgtaagataaaagctatatttccagcgaagtatagctttttttatagctatagtttttgcttttacatattacttaccagcatagaaaaatattcaagttattataggatgttatatgtcattagatttaagcgaaattcgtcaacaaattacacaaattgaccgcagtttattaaagctgctctcagagcgtcatcgtttagcatttgatgttgtacgcagtaaagaaattacacagaaagcattgcgtgatgttcaacgtgagcaacaattattgaaagagttggtgcaatttgcggataatgaaaattatcaattggaaccacaatatattactcaaattttccaaaaaattatcgaggactccgtattaactcagcaagtatatttacaaaagaaattgaatgagcaaagagagaagaatattcatattgcttttttaggtaaaagaggttcttactcgcatttagccgccagaaattatgcaactcgttatcaggagcaactaattgagctaagttgtgcgtcttttgatgaagtattttcctctgtgcaaaatgaggaggcaaattatggcattttaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttaaagcgagttcatattgaatattgtgaaagcagctcacatgcaatgcagcttgttgccagcttaaataaacctaatattgcggctttaggcaatgaagacggtgggaatttgtatggtttaaaagtactaaagtcaggcatagcaaaccaagaaaacaatattacgcgatttattgttcttgctaagcatccgatcgcagtatcaccgcaaattcatacaaagaccttattgttaatgagtactgctcagaaagtgggtgccttagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaataaaaagtgcggtctaaatcaaaaaaatcccctttattgaaaaaggggattaggcgttgatttattttttcggtgcaagcaaatcaggttcttgaggtttcgctacattttcaaaagatttattttgattcgcttgaataaggctgtctgcttgttgagccaattttgttagccccattttttcgtaagcatttttcatcaatggcaacgcatcaagagtagcttttgtgtcaggatattgttgtaacatacccactacacgatttgctacagcaacatgagcattgcgttttgcatagaatttagcaatttccaattcatgacgagcgaggcttgctctaatataagccatacgtgctaaagcatccgacgcataagagccatttgggaaatgctgaactaacgtttggaagttagcaaatgcagttttgatagacgtactttcacgtgtcgcacgatctacaccaaaaaggtcttggaaccagttatcacctaatgctgaattgcttaaacctgctatataaatgacataatctaaatgcgagctttgcgggtattgttgaataaagcgatcaattgttactaaagcattagtgtagtcttgagatttatagtaagcataaattagatccaattgtacttgttcattatattggcttccggggaagcgtttttttgccgtgtctaaataacgaattgcttggctataatctgcgtcttgtagatagctgtgtcctttttcataaagagtttgtgctgttccttcttcaatagctttacctgagcttgaacacgcaccaagagcaaggcttgcaaaagcgactaaagcgagagatttcaatttatgcatgagtgaatccttatttttacaatcaataataaatgttacaataattcgttattttatagcacattgctaaataagcaaattatctgatggattttttattatgacacaagtgatattgtcagccgatattcagccccaacatatgggacaacgcttagaccaaacgttagcagaattgttcccggattattcccgctctcgtttgaaaacatggattgagggtgatttagttaaagttaatggcgaaattattaatgttgctcgtacaaaagtttacggtggtgagttagtggaactttgtgtggaaattgaagaagaaagcaggtttgaacctgaaaatttaccactcaatattgtttatgaggatgagcatattttagttattaataaaccaaaagattttgttgtccatcccggtgcagggaatcaaagaggaactgtattaaatgcactgttgtatcattatccaaaaatagtagaagtgccaagagcgggcatagttcatcgtttggataaagatacgacaggtttaatggttgttgcaaagacaattccggcacaaacaaaattggtacaggatttacaaaaacgtaaaattatacgtgaatacgaagcagttgcttttggtgtgatgacacaaggtggaaaagtagatcaacccatgtccagacatccgacaaaacgtactcaaatggcggttcatccgttgggaaaaccggcggtaactcattatcgtataatggaacgtttccgcaattatactcgcttacgccttcgtttggaaacaggacgcactcatcaaattcgagtgcatatggcacatatttcccatcatttactaggcgatcaaacttatggaggtcgtcctcgtccaccgaaaaatgcaagtgaagaatttatgcaagtgatgcgtgattttaaacgtcaagcgttgcatgcaattatgctccgcttaactcatcccattacaggcgaaataatggaatgggaggctcctttgcctgatgactttgtaacattaatcaatgccttaaaagcagattatcaattacataaagatgaattagattattagtatgcaaataataaaagcgaatctcggtcaagtagcgaatgttcaagggctaatgacaactcggcaaggcggtataagtgttgcaccttatgacagcttaaacttgggtgatcatgtcggtgatgatgaaagtgcggttaaaattaaccgcactttgttagtgaaagaattaggcttaccgcaagatcctatttttcttaaccaaacgcatagtacaaaagttctgcgacttccttatcaagaaggcatggatttaaatgcagatgcagtttatagtgatcaagctaaccaagtttgtttggtgatgacggcagattgtttgccagtactttttactaatagacaaggcaatgaagttgctgctgctcatgccggttggcgaggattatgcgacggtattttagaagaaaccgttaagcaatttcgtgttcccaaagaagatattatagcttggctaggtgttgctatcggccctaagttttttcaggtcggtaaagaggttgttgagcaatttatagcaaaagatcctcaagctaaaaatgcctttacgccagatcgggaacaggaaaataaatttctgggtaatctgtatcaaatcgccaaacagcgtctaaatgctttgggaattacagaaatttacggcggagaacattgtacatatagcgataaagagcggttcttttcttatcgtcgtgatggtaagacaggtcgattggcttcattgatctggttttccaagtaaaaaagagcggttagttgtattgagtatctaaccgcttaacagggaatagttattatccttcgaagccgtcaaacaaggctgtgcttaaatatcgttctgatgcagaaggtaagataacaacaatgagtttatcggaaaattccggacgttgtgcaattcgatcggctacagcgagtgctgcaccggatgagatccctccgagaataccttcttctgccattagacgacgagccgttataatcgctgtttcactactgactttttctacttgatctactaaagataaatctaagtttttcggaatgaaccccgcaccaataccttgaattttatgtggccccggtttggtttcttcacctgccagcgtttgagttatcactggtgattcttcaggttcaacggctacggtaataattttttttccttgatcttgcttaatgtaacggctaattccactaattgttccgccagtaccaacaccagctaccaatacatcaattttaccttcagtgcctgaccaaatttcaggtcctgttgtttgttgatgaatggctggatttgcagggttttcaaactgttttagcattacatagtgatttggatttgaagcaacaatttcttccgctttagcaatagcccccttcataccattgacaccttcagtcaacactaaatttacccctaaacctcgcaataagcgtttacgttcggaactcatagtctccggcatagttaacgtgattttatagccacgtgctgcagcaacataagctaaagcaatacctgtattaccactagttgcatcaataatttctttatctttggttaaaataccatctttttctgcttgccataccatattggcaccaatgcggcatttcacgctaaagctggggtttctcccttcaattttcgctataatgttgccgttattaccaaagttttttaaacgaactaatggtgtattaccaatagaataggaattatctgcataaattgtcattattttctcctaagagttgtgagttgtattttttacagtatttttatcatagctttatgaattgcaaaatagcaaaacattctattttataactaaacgctatttcacaatcgtggttttaatccgtatgaggtttgttaatgtcgttcttaccggcataacgatattgttcaacccacatagctgttgcaccacagacagcaacaggaataatcagcaaattaatgagcggaataaatgtacataaagtcaccaaagtaccaaaagttaacgttaatgtatgtttctgtccaagttccgttttcatacgttgaaaaggcactttatggttatcaaaaggatagtcgcaatattgaatagtcatcatccatacagtaaacaaaaatgctaaaattggaataatgctttgtccaataaatggaatgaaactaagtagagatagagcaataattcgaggtaagctataagtcaatttttgcaattctcgttttagcattcttggaatatcttttagaaaatctaccgcacttccttcagtcggactttctcccgttaacattttttccactttttcagcgagcaaggcattaaaaggtgcggcaataaatccagagagtgttgtaaacataaaataaaaaatgcttaacaacataagtacagctaagatgagcagaatcatacttaaccagctaagccaatcgggaataaacgtgatcatgctctcgagccaagtactgaatcggtttataaacaaccataacagccccgataaaagaagaatgttaagcaaaatcggcataacgacaaaacgacgcaaaccacgttgtctaatcaaatcccaacccataataaagtaatgaaaagctttttttatctctgttagttttaacataaattttccttaattgaaaaaacacacttatcaaacgacataataccgcagaattcaagtagggtaaaaaatctgtattttccatattaatcaacaagtaaaatatgataagctagcaaaaatttgctgttcgatgaagctaagtaggagaacaagataatggatttaaatgctattttaattattttaggtgtaatcgcattaataattttagttgcacatggcatatggtctaatcgccgcgaaaaatcgcagtattttgaaaattcaaaaaactttactcgagaggcacgtatccgtgaaccacaagaaaatcagcaatatcaaaccgctgatcaatctcagtcggattttcaacgtaatttgcttgaaactgataatgactgtttttctagtgaatcagcacataattctcaccaacctctttatcattatagtgagcaaagtgcggtacaatctgttgatcaaattaaaattaggttgcctgacagtgagcctaactatgtaatgcaagaacagttctcaccgaagcataccgactacgcctccatgagcattgaagaactggaaaaatcaattgatcttgatgagggaattaattcatcttctcaacatttacgccaagagctagctcaaatttcagggaaatcaatagctgatgataaggtcaatatagaagagcatatgtttactgaaagcagcatatcttttgtagaaccacagacaaacgcggaatcccaacaggttgctgaaaaaacaaaatcaggtaattcttcttttatcatgctttatgtggttgcctctgaaaatcaaggttttagcggtttgcaattgactaaaacacttgatgagctaggatttatttttggtaaaaaacagatttatcatcgtcatgtggacttaagtattacaagccctgttttgtttagtgtggcaaatattgaacagcccggtacgtttgatttaacaaacattgcagatttttacacggttggaattgcattatttatgcaactgccttcttatggtaatgctacagccaatttacgaatgatgattagagcggcaaaaaccatcgctcaagatttagacggtgttgttgtaacagagcaacaagaaatttttgatgaacaggctgaaagggattatttggctcgtgtttcttgagtggcaaaatttgggaaatattgaccgcactttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccataaaatatgatttatatcaataaagtattcaatgttggttgagtttgtaggctaaaattttgtagtatatgcaccatcaagtgattgcttgatgttcataaagttcctaaataaaataatcataatatagcaaaactgctttgtgacctccctcttgggaggtttttttaattaattacaaagttggaagtttaacgtttctttgactgataaactgttcttttcctgtatgtctatggcactaagtccttactcgctaaatttctacgttcaattcgctaaatcctataatttcaagtaaaataaccgcactttttacatcatagagagaatatatgtcatcacaatttgtttatactatgcacagagtaggtaaagtagttccgccgaaacgtcatattttaaaagatatttctttaagtttctttcccggtgcaaaaatcggagtgcttggcttaaatggtgccggtaaatctaccttattacgtattatggctggaattgataaggatattgagggagaagctcgcccacaacctggtattaaaattggttatttgccacaagaacctaagcttgaacctcaacaaaccgttcgagagaccattgaggaagctgtcactgaggtaaaaaatgcgttagttcgcttagatgaggtttatgcattatatgcagatcctgaagcagactttgataaattagcaaccgaacaggcaaatcttgaggcgattattcaagctcatgatggacataatttagaaaatcaattagaacgtgcggcagacgccttacgtttaccggattggaatgccaagatagaacatctatcaggcggtgagcgtcgtcgtgtagcactttgccgtctattacttgaaaaaccggatatgttgttacttgatgaacccactaaccacttagatgcggaatccgtggcttggctagaacgtttcttacatgattatgaggggaccgttgtggcaatcacccatgatagatacttcttagataatgtggcaggctggattttagagcttgaccgaggagagggtattccttgggaaggcaattactcctcttggttagaacagaaagagaaacgtttagctcaagagcaagctacagagtccgctcgtcaaaaatctattgaaaaggaattggaatgggttcggcaaaatcctaaaggtcgtcaagctaaaagcaaagctcgcatggcacgctttgaagagcttaactcaagcgaatatcaaaaacgcaacgaaactaacgaactcttcattccacccggtccacgtttgggtgataaagttattgaagtgcagaatctgaccaaatcttatggcgaccgcactttaattgataatctttctttcagtattccaaaaggggcgattgtggggattatcggagcaaatggtgctgggaaatccactttattccgtatgctttcaggacaggaacaggcagattctggctctattactttaggtgaaaccgtggtaatggcatcggttgatcaatttcgtgatgcgatggatgacaaaaaaacggtttgggaagaagtttccggcggcttggatattatgaaaatcggtaattttgaaatcccaagccgtgcttacgttggacgtttcaacttcaaaggcgttgatcaacaaaaacgtgtcggtgaattatccggtggtgagcgtgggcgtttacatttagccaaacttctacaagtgggcggaaacgtattactattggatgaaccaaccaatgacctagatgtagaaacgttacgtgcattagaaaatgcgatattggaatttccgggttgtgccatggttatatcccatgaccgttggttcttagatcgtattgctacccacattctcgattatggtgatgaaggtaaagttactttctacgaaggtaactttaccgactatgaagaatggaagaagaaaactttcggtgcagaagcaactcagccacatcgtattaagtataaacgtattgcaaaataattctttgtataaagggaaatattatgaaaaaaatcattaccgtattatcagttttagctgtatctgcttgtgtttcaacagagctatcgacacaaaataagacatataacaatttacaagatgcacgtatccgtttatatgggcaaaatcgtcgtccctcatcaatggaaattgaaattaatggcaagactgaaaaaatcaccgttggaggtggtttgggacaggcttttggttcaatgcttggagttaaagggaatgaaagcattggtatgcctgaaactgaacttagcaaagatccttctgctcattcaaaactactttcggctatcttctttaaagaattcgttataccggcaggtaaagaagtaaaagttactaacagtattcatgacgtaacgaatatgggagaatattatacctcaacacatagaataaccaccactacaacatttaaagggtgtaacggtgatgtcattacttttattgcagaagcaggaaaagattatgaagtggctcctattagctctaatagagaatgtggtgtaactgtttacgagatcaaataattttatcagaagcccattataaactgtctataaagtaaccgcactttaagtgcggttcttttatgttgcgtgattatggcaggctcaatatcagcaataggatattcacttttaccggaaaaatcattgaaaattaacaatgacaacataaagctttctagatgaaatcagcacagaagagttgccccgaaggcactaaaaagattagcgaccgtatgtgttgaacaagaactttgccgagcttttatctgagaaagtcaaacagctcgtcgtactgtgctgtttgttgctaaaagtgttggttttattggaaacctaacctagtcataaaactctgtaaaactgtttgcggatctaaaaatattgaagaaaacaaccgcacttattggattaaagtgcggtaagtatttagctcaaattagaagcagtgataagacgttgtgtataagcatttttaggttgagtaaatacctgctcggttgtacctgtttcgacaacctcacctttactcatcacaataacattatcgcttagtgcttttactacagataagtcatgactaataaaaatatagctcaagccatattttcgttgtagtttattgagtaattcgatgacggtaatttgtgttgaacgatcgagtgcagaagtcggctcgtccagcagaacaaatttcggttcaagaataatcgcacgggcaatagcaatgcgttgtcgctgtccgcctgaaaactcatgagggtaacgattaatcatagagggagaaagattaacttcctccaacatattcatgactttttgtcgcctctcttgtttactcatgtgcgggcaatgcacagtaagaccttctgcaataattttatggggtagtaacaatatttgcataaagtaaaagaaaaatttgggtcggaaaaagttaggtgagggcttgtggttattgggtttgttgaggttggggcgttggttttatgcaaaatagggaaatgagcaggaatggtaaaaaatgggtaaaaattggattattttttgcataaaagtgatcagggtttagatggtttttaaaagatttttaaaacaggtttaaaactctaaaaatggtagtaaaaactaggcaaggcgatttcaggtgaaatcgcctttatttttttggggggaaatcttgtggttttggtgcgtttaggtgaaatctgacttatttttgtgagggattatgcctaaaaatcacgatagccacgcactacttgcccaataacgataaggctatttgcttcttcagcttctagctttaatgggcggtatgttgggttatcgctaattaactctaccccatcataggttaactgcacttttttcactagcattgacccatcattatttaaaacaaatattttcccatcaactaaattacgtttagagcgatccacaatgatttcttcaccatcttttaaggttggatacatactttcaccgctcaccaaaaaacattgcacagttttcagcctttaagtgctttgtttgtagccaaacaagttctacttttatcatctgtgagaactacacagtaaatttatttaactgtgtagttagtaccaattttttataaagtaaacagaatacataaaagaacaatataatcaatgtgttataaattttaggcgttttttttcggatttctttttgtgtagtctaataactctttttctgtgtattcagctaaacgcatattagcgattgaatgcttacaacacattttggctgtttcggagattaactgcttaccttgagtatcacttcttctaaaatttgccagtaactttatttcatccatattcagtaaaactggatttattgcatcagaaggcgtgattagtgaagggttaattgtggcagaataatcatccatatctatttcagttgctttatctttaatggcgttcacaagatcctcattattagcattatttggttctctaatcccagatagaatgtaattgatatccagttttaaatctggacgctcaagctctaatagtcttaaggcattttcaggaaatacacctctacgctttctttcagcaaaggcactttttgacatttttaaaagttcagccacctctttatccatcgttaatgatagttcagtttttaatcgattggcgatgtctgtgaaatttttcataaaaaacctcttgaaattcataaaaatcatatttaatatgaactcagtaaacaataatgaactttatgatttcatattaattcgtattgttcttattctagttcaaaatatgtttttagtccatagaggagtttatatgaaaaaaagaacgagagatgaagctaaaaattggttcagagaaatgaatgtaacgcaatctgaatgggggcgaagaaatggttatagctctaatgaaattagccgagtattgacgggaaaatcaaaatgcctttatggaagagaacgagaaattgctattaaactcaatatagctttagaaagttagaggttcatatgtgtgaactaaagccatactattctgctcaagagttaataggtttacagctagtaatcttaccaacgaccaaaaaagcagtaatagacaaagccaaacgcgaaaattggcaatctcgtaaacgtgttggtcgtggcggtggtgttgaatacgccctttcctctctccctcaagaggtgcaagaggaaatcagagataaatttgcgacctcggttgtggcgggcaagcctaaaaagttgccagtgttgaaatcggtcgtgttggaagacctcaccgaaaaacaacgccaagcggcagatgcaagaatgacgttagtggcttatatcttgcagttggagcaagcacaacctcgttataaagcggtgaagtttttttgccagcaggcgaaacaaaatttgttatcacctgaattaatggcattagtggctaaggcgaataacaaaaaaggtgaaagccgtgtgattggtgaacgcaccttaaatcaatgggtgttggattatgaaaaagcgagcaccccagaagaacgtttaaaagctcttgcccctatgcaacgggtggcaaaaaaggcagaagacatttcgtggttgcctgattttctagcggaataccgccaaaccaatggcattaatgtggcagaagcctatgggtattttgctcaacattggcgagagcgttttgaggatcaacccttaatgcttgagatgttgccaagtcttaatcgtgtcagaagagcgttagccaaattgcctcgccatattaaagaaattgggcgtaaaacggggtcagagcttcgggcattaaacacttatgtgaagcgggattggtcgaaattgttggtaaatgacatctgggtaggcgatggacacagtatgaaaatgaaagtggctcaccctgaacacggtagcccttttatccctgaaatcacgctgattatggacgccccttgtcgttacattgtgggttggtcggcaagtctgtcagaaaatgcccttgcggtggcagatgcgttacgcaatgggatcgaacagcacggtatccctgcgatttattactccgataacgggggcggtgagaaaaactggctacttgatggggatattacagggatgttgccccgtttaggcatcaatcaccaaacagggataccgggcaacccacaagggcgtgggattattgagcgggtacaccaaacgattttataccgcattgcacgccaatttgaaacctatcacggcagcggtgctgatagggaaacggtgagaaaggttagcactggcgtggtatcccttgaaaaagccttgcgaaaaggcactgcacttgaagatttaaccccgaaacaacgcggggctatggggaagttacccagttggaatcagtttttagatgcggtgcaagcgggcatagattggtacaacaacgagcataaacacagtgaaatcggcaatgttacccccgcagccaaacgccgtgaattaatggcaaaaacgaatgaagaaaacttggtttacctcacccaagttgaagcacgggatctgttccgcccagcggtagagcgtacaccagagcgaggttgggtgcggttgtttaataacttttactttagtgcgaagttgttagaggtagatagagaaaaagtgcaggtggcatttgatattcacgacccaagccgtgtgattattcgcaggctagatggggtgtttgtctgttatgcagagcttgatggcaataagcgtgatgcgttcccgatgagttttgtggagaaaacgagaaaagagcgtcatcaacgccgaatgaagctaaaacaagagcaacttgatgaaattaatgcggaactcaaccccgtgcttaccattgaacacaaagaaagtgcggattggttacatcagttacgcataaataaacaaaatgaatgggaggaagacgcggaagaaattgcggttttcccaagtgaaatgaaacgtcaattattaaaaagaaaggcaggttaaacaatgaaagagcaattacaacactatatgcagacacaggggctaacgcaggggcaaattgctaaggcgattggtaaatccatcaccactgtgagccagtatttaaaaggcaattacaacgggaaaaccgatgaaattgatgatgccgttgcccgcttgttgcaacgtgaaaaagataaggtggtggaacgccgttttaacagcgaatttgtggaaacttacgcggcacagcgttgtttagatgctatctacattgcccacgcagaaagtgatattgcagtgatcacaggggcggcaggtttaggcaaaacccaagcactaaaacactacatggaacgcaaccctgaaaccatttttgtggaagttgaaccaagttacagcccgaaagtgttacttaaaaatctgtgtcagcagttgggactaaacgaaaacggactaaatcacgagctctttacccgtatcaccgaaaaacttggcgaaaaccgcttaattattgtggacgaagcggaactattaagcacgaaaagtttggaatatttacgccgtatccacgatttaaccaagtgcggtgtggtgttggcaggaatgccgagattaatcgttaatttaaaaggtaaatatggtgagttagcccagttatacagccgtgcgggcgtacattgcgatttacaaaacgccctagataaggaagacatcgccttacttgcccagcaaggcttaggtacggacgaatttaacgacctgctttacaaagtaagcaaaggcaacgcaagacgattgaacaagttaatgcgtggcgtgatccgcgtggcggaaatgcacggaaaaccgattagcgaggcactgattaaccgttatgcggaaatgttgattaattaaggaggaaatatgggctttaaaacaaaagagtttgataactggataggaaaaaatggtgacattttgatttctaaaaattcaaaagataaatggattgctgcagggggatggagcgaagaagaggacgactttactttgtacagcgtattaaagaatagaaaggcatggctgaatttttaccgtcaaacgagagtgactaaataaggattaaggagaaagaaaatggcaagagcagacattattgacacagcttatgcgttacgtcgtgagggtgtggagattgtgaaatcaaaagatgggcgttttccgagttttttaattttacgcccaagccaacgcttaatagcaaatgcaacgcagattgtggaacgcattaacgggcaacgccgtgagcggtttatcactcaagtgggaaattgtacggtgtactggttttgaggtgagcaatggcaaagtctctggatatttacgccgtctatgagggtgaggataacttaggtgacggcacagcggaacagttagcaaagcaatttaacttaagtaaaacaacgatttaccgttatgctaagttaggcgataaaggaagtaagaaaaaacggttaatcatcatcaaaattgataaagaggaaaaagaaaaatgaaaaaaattgccgtaatttgcaccgcacttttgttggcggggtgcattgaaaaagcgccacttaatgatatacagccaataaaaaggtatcaggtaagcgcatacggcgaacttaaagaggtatgtattgatggtgtggtgtatctactactcataaagggtggtattaccccaaaaatcaacgccaattatgacgtttatatctgtaaccaatcaactaacccataggagaaaacaatgaaaactgtaatcgaaggcaaaacctactggaaagatgcaaaaggcaaccttaccccagaagaattagtgaaagacatcgacaaagaacgcgatgcactggtgcaagaatgggtagaaaaagccaaagccttaaacgcggaaatgagccgttttaaaggcgggatttttggcgatattcaggcgtttgtggaactttccgccgaaaaatacggcacaaaactgggtggcaataaaggcaacgtaacgctatttagctatgacggtaaatacaaaatcgtgcgagcgattagcgatcatttgcaatttgatgaacgcattcaggcggctaaggcgttaattgatgagtgccttagcgaatggtcggaaggctctcgcccagagctaaaaaccttgattgagcgagcgtttgatgtggataaagaaggcaatatcaacacagggagaattttaggcttacgccgtgtggaaatcaccgacccacgttggctaaatgcaatgcaagccattagcgaaagtgtgcaaatcgtaagcagtaaagcctatgtgcgaatttatgagcgggtgggtgatagcgatcaatatcagccgattagtttggatatggcggggatgtaaaaatgtttgaagatgttagtgatttaaaagaagcctatgatttttataaagcagttaagaaagataaagatgctattaggtgtggttgtttaagtgacgcagaagattggatatggagagagccgcatgcgttatttgcagaagacgatgagcaggaggtatagcaatgttagagaaagttgcaaaatacagtcgaattttttcgggagcagtggcgattaccatattgctgattgcagtgcctgtgttttttatccacgaagccgtagcgataaagttgatggcgtcagcgtgtaatttttttgccatttttgtcttttttgaggttttaaaccttaaaagttgggtacaacaaaatatcgcaacattgataaaaagtgcagaaattgcatcaaaagccgcttatagcttaaagcagcataaagggctaaatcttgtggtcaatggcaacacagttacacctgatagtagtgaacgggaggtataaatggaaatgttactttatatcgctgttggcgcatttttattccctttttgttttggtttaggttgtatatgcgtctataaaatgatggagaaattggtcaagttaaatatggcttaaagcccttttcaacacgctttaaagcccatttaaggcgtgtttataaagtgttttaaatcaaaaaataggagcaatgacaatgaattatcacgctgaaatagacgttaaattgactttgggtattgaagctgaaaccaaagacgaggcgatatgttatatcgaccaactactggaagaaatccatgaaggctacgctattggtctgaagtatcgaattaattttgtaaatgaggaatgcgacgatgaagaataaatatcttgtcagagtgtacggaatggttgaaatcaccatggaagccgaaagtattgagcaggcaatggcacaatgtgatttgaataccttagatttaaataaattgccacatcaaatcactgaaattgatgatgtagttgaagtggaggaagtatgacaaagcaaaaacaaagcgaactccagctcaagctggatatgatgatcggacagcttcaacaggcggttagagcgattaatacgggcaactatattgcggcgggggtrtatatggaaatggtncaaaaccaactgcnaaaggcgagatggcaggtaagggggtaaagatgaaatcttttacattaattttaacagcaacttttgattttcgcgatgatgaatttaatgatatcggttttaaatggtctagtatagacggaaaggcattattagatgcgccaagagaactggattttacaatttataaattgatgaaagattgtacttacgcattgcctattttatcccatttttttaaggagtttagtcaagagaagcaacccgtcatggcaactgcaagcgtgcagtttgaaggggaaaatgaggattggcagctagctttttctgcactagaaaaaaacgaagtaaacgaatatatccaaggattgctttttgggttgctaacacagagaaatgaacttttgcggaaggtgaagttattggaaaaggaattgtattaaaacccatttaccgcccttttaaatctcccctagcccctctttaccaaagaggggaactgaaagggcggaataatgtgttttaaccccgttttaaaaggagtttaaaaatgaaatgtaaatgccctgcgtgcggggcggtgttgtcgttagatgtgttgttgcaacacgagcaagcgagccttgcggtgatgaatgccttatcgctcaatggcgagtttgggcggttggcggtgcagtatttagctctattccgccctgaaaaatccgcactcacaatggatcgcttagcgaaactactcagtgaattggttgatgaggtgcaacgcgggcagttttgccgtaatgggcaggtttattcagcccccattgaatgttggattgatggcttaaccattgtgttaaatagtcgccaccatatcaaacgcccctcgcctcacacggctatttgtatgaggtgatgaccaaatggcaaggcagaaatagccatcataatatgatgaacggacaaagtaatccgcctgccactgccccacaattcggcagcaaaacgggcaaagctctgcaaaatttagcggagtttgccaatggctgacgaaaaatggctaaaacgaaccgtagctcaagggttgggaaaattggtggtgttacgccttgccaaccaaccgcccgaagagatgatcaaggctacggcagaagtgtgggtgcaggtgattttaagccaacgcatttatggcggctggcaagagaaagaagataaatggcgaattgaacaggcgtttatgcggttatgtgcagaatgtgagcgtttccccgccccgaaaatgctgttagaccgcttacccaaacgtaaaacccttgaactaccaccacctcaaccaaaaccattaaccccagaacaacaagcgtgcgtcagtaaaatgttaaacgaatggcgaggagtattaaatgcaaaacgatagttaccgaaaaaatctcattgctaaagtgcatattggtaaaagtcagttaaaaatggacgaagaaacctaccgcacttttttaatgaacgccgtaaataaaaccagttgcaaagcaatgagtaacaccgagcttaatcaagtgttggatttaatggcacaacgtggggcaaaagtgcggtcgaatttttggggaaatcgcccaagtccagctaaagcgaaaaagccgtaccttgccaaaatcaccgcattacttgctaagcataatcttacaccgcaatatgctgacgcgattggcaaaaaagcctttggtattgaatttattgactggcttgctgtgtggcaattaaaaaaagtgattcaaatgttgtcggtgtatgataataagaagaagttgtaaaacattttgcataagtataaattaaaggttcgttttgagccttttttaatggagcaaatatgagaaaactgataaatctcttaatatttacaataatacttattccagtatcactgcaattattatctaatcctgcttggggaaagggtcgttatctgccaaaatgcaatgaagtagatgatcttttaagccaaattttaaatcagcaaactaaagaaacaaatattgacttaacgctcaaaaacattactgctgttagagaggtaaaaaagatagaacaagataaaaatatacgtctttgctacgcaattttacaaacggcaacctacaataaactagaagcattatattcggtttctcctgatggtaatgatttttgggtgcaaatagaagaagtaaaccctattattgatgccaagacattaagtaaaacgggtgatatgttaaataatcaaatgggagaagatagattacaggcttttgaaatggcgaaaaaatttggtgatatgaaagaggcttgtctatccttgagtgtcgccaaaaatttttcttaagtgcaaaaaatgaggttaaatatatacaaaccaataaactattagaagagttctgcaaaaagtaagtataggctatctaaaatcccgccaagtgcgggatttttttcaaaaaattctccagttaagtgatcgtttgaaaaatcccgtgtgataatggcgaaaaaatcaatacgggagattaaaaatgagtcatcttgaagatgttgcagactgcttaccccctgttgtactggaaatggtggatttggtgggctttgaggtaaccgaaaaaatcattcgtcattttggcggggtatgttttttatttagtgatggtgcgatgtatttcccgaaactaaaatcgctggttggattagaacatgccaccgcactacgccagtattttaaaagtgaagaagtctatattcctcgctgtgaagtggcattaagaaccttacgtaatattcgcttggtgaatgactttttaattaaaacccaagtggagggaaaaagcgggcgtgcagcaatgttggaactttgcaccaaatatgccctttctgatcgccaagcgtgggaaattgtgcgtaatgcccaacgtaactcaccgcttgcaacccaatcatccctattttaactgtggaagtgctttgtctattaggctaaccacacaaatctgataatcacctcaataatgtctttgattattgaggttttttatgccctttccaattacaaaaattgtggtgcattgtagtgccacgcagaacggtaaatccttacgcaatgaaaggctaaccgcagcccaacggattgatctttggcacgctaagcgaggttttttgcggaaaaatcaccaatttaacccgtacttacgccatatcggctatcactttgtgattgataccgacggcactgtagaaacaggacgtgcagaaggagaaatcggcgcacacgttaaagggcataacgcccatagtttaggcatttgtcttgtaggtggcattagcatcacaggcaaaaactacggacgctacactgtcaaacaatggcaagccttgtatcaactcttacaaaagttagaagccaaatacccagaagcacgcatttgcgggcatcgggatttatcgcctgatttaaacggtgatggcacgattaccccaaacgaatgggtaaaagactgcccgtgctttgatgtttgggagtggctggatagcgagcaagtgattaatcaatcacacttatttaaggagtaattatgccaacgactattttaggtattatcgccgtaacaatggtaatcggttgttttttcaaggtcggggaagctatcggagcttgtatcggcgatcagattaaatatcgctatgtactttggcgagataaacgaggggaaaaatgaaactcagtgaattaattaccaacgataacggcaggcttagcaccaccgcctttatccaatttttcggagcggttttaatggcgatcattttggcgtatagcgtctatttagaccgtgcaaatgtaagcgaactgtttaccacctttgctttattttgtggcggcggtgtggccaccaaaggctttgccaatgcccttaatcgccgtaaatcttcactagcacaaggagaagaacaatgatgtggcagatgtatgcccttgcggggctaggtgcagtgtttgtggcgatttatgctcggttacattggcaaagtaaaaaactcagtgaaaagcaaaaagaaatcgaaatggtgaaagccgaagccagagccatcgcggaggaaatggaaaatgcagaaaaacgtcagcaaattgaagcagctcatcgccgtcttaacgctcacggcgttgatgaccagttgcagtcaaaaggttacttccgtgaggattagcggttgcagtgcgtttgggctgatttaccccagtcgtcaagatacattagaaaccaaacggcaggtgctgaaccataatttagcctatgagcagatttgcggggtgaaacgtggatctacaaattagcggtgagtgggtgtttaacggggtggtatccattgccgttacctttgtcgggttttggttgcgatcggtcaaggaagagctgaaagaactcaaacaagaatgcaaagacatccgcaataactatcaaactaaagagcttgccaaggtgcatagcacacacacggacaatattttggcggaaattcgggacgaattaaaagcaatgaatcataaattagacagcaaggtggataaataatgtcagccagagaacaaaagcgtttgaaccaacgcaacaccaacgaaaaactcgatgaactgttggatttaagcaaagaagcgaatcgcaaaatcgaccgtattggggagcgggtcaatgatattgatcatcgtttgtcatcgctcgaaacccaagtgggcaaagtgaccaccaaagcctttgtggctggcggtttaggtggtgcaatggttgcggtgggcattgagttaatcaaagcaaaatttgggggctaaatggctcacgatgagaaagtgcgggcattagtacgccgttattatgtgtttgaccgctttacccttgagcaatctgcacaaaaagccgacgtgtcttttggtacagcgcgccgttggaaagcgcaagccctaaataaaggggacgattgggataaggcgcgcgatgtgcatattatggcaggcggtgaagtgaatatgatttcgcaaggtttattggcgggatttattttgcagtatcgcaccacaatggacgaattacagcaaaacactgaattgagtgccaaggataaggtgatgttacttgccgcccttgcggatagctttaccaaaatgacggcagcaagtaagcggattttgccagaagtatctgaattggcggtggcaatgcgtaccgttgagttatttggtgagtatatccatcaacatcattcttccctaatggagccttttattgatgcattgaatggatttgggcaaacactcaatgaggaatttaaaaaatgaacctattgagttttctttttgtgattgcggcttgcctttctgcccgtgatggtggggcgtggggctggtgggtatttttagcattattagtgagtgattaaaatgaaaagcaaagattttttgaaagaattaagtgcttatgctgatagcctacggcaaaagttagaagcctcttttgagggctggaatgatagccctgaagccgtggttgaacgccgtaaaaaagtgtttgatacgatttcgggttatgaatattttgtcaatcattactttccgcattacacccgctcaagctcaaaatccaaattgcatcattatctatttgaacgcttgcccgccattttacagcaagagaaaggttgcctagatgccattgctgcaccccgtggtgaagctaaatctaccttggtttcgcagctttatactctttattgcttggtgacccaacagaaaaaatattgcctcattgtcatggacagtatcgaccaagcctacccaatgttggaagccattaaagtggagttggaatttaatcaacggctacgcattgattttcccgaagtggcaggacaagggcgtgtgtggcaagcagcaacgattgttacccacgctaatcaaaaggtgcaagtggcaggttcgggcaaaaaattgcgtggtttacgccacggggcatttcgtcctgatttggtggtgctggatgatattgaaaatgacgaacaagtcagaagtccagaacagcgggataaattgcataactggttaaaaaagaccgtgttaccgcttggctctgcgggggataaatttgacattgtgtatatcgggacaatcctgcattacgacagtgtactcaatcgcaccttgcacaataaagcgtggcatacggcaaaatttaaagcactcacaaaaatgcccgacaatatggcgttatgggataagtgggaagatttttacctaaacgagggcgaagcggttgccgatgccttttatcagcaaaataaagccgaaatggacgcaggagcggaaatctcttgggcagctcgtccactcttggcgttaatgaaaatccgagcacgagatggacacgccacctttgatagcgaataccaaaacgacccggttagcggtgatgatgccatttttgccaacagtatccaatattggacatcactccctgataacctgatttattttggtgcgcttgacccttcaatgggtaaggcgggagctagtcgcgacccgtccgcaattttagtgggtggctatcatcgcgaaacaggcaagctctatgtgattgaggcgcagattaaaaagcgtctgcccgatttaattatcgaagatgtgattaggctcaatagccaataccaatgccaccgttggtttgtggaaacggtgcaatttcaggaatttttgcaaacagaacttgttaagcgttccgcccaacggggcaagcctgtgccagccacggcgattaaaccgaataccgataaaatgctacgtattgagagcttacaaccgcatatcgccaatggcttaattttgttgcatcacagtcaatccaccttaatttcacagctacgtcatttcccaaaagccgaccacgatgatggtcccgatgccttagaaatgctatggaaaaatgcggtgctcaactctgcctccattgagtggacaagcctgaatgaagcagagttagataacgattggcgtgatgaagatgatgatatttatagcatttggaaaggataaacaatggcaaagaaaaaacgcaataagcacaaacaagcacaaaataaaagtgcggttaaaattgggcaagattttcaaaccaacgaagctcgtattacggagaatgggcggattatttccgaccacccaagcaataaaatcacgcctgccaagttaaaaagtatttttgaggatgctgaggcgggcaatatccaaacccagcacgaactctttatggatattgaagagcgggacggcgatattgcggcaaatatggcaacccgcaaacgggcgattttaacgctggattggcgaatcgccgaacctcgcaatgccacgaccgccgagcagggctatcaacaagaggtggacgaatatttttatcaattttccgagctggaaaacctgctgatggatttaatggatgcagtgggccacggcttttcggcgttagaaattgattggcattttattaacggaaaatggcaaccaaaaacctttatacaccgtccgcaatcgtggtttaagattgataaagacgacaatttattactcaaaacccctgataattacgaaggtgagccactacgcccattgggctgggtggtgcatacgcataaaactcgctcaattcagttagctcgccttggtttgtatcgtacacttgcgtggcattatatgtttaagcattacgccgtccacgactttgccgagtttttggagctgtatggtatgcctattcgcattggaaaatacggtgcgggggcaaccaatgaggaaaaacgtacccttttgcgtgctttggctcaaattggacataacgcggcgggcattatgcctgaaagtatggaaattgagctacataatgcggcgaatggctcaagcgttaataacccatttttgcaaatgattgagtggtgtcgtaccgagattgctcgcctgattttggggcaaacgctcacatcaggagcggacggtaaaagctcaaccaatgcacttggcaaggtgcataacgaagtacgccgtgatttgctgattgccgatgccaaacaaattgcacagaccattaccaagcaaattattttgccttatttacagctcaatgttgatccgagcattgatgaaagccgctgccctcgctttgagtttgacaccgcagaatatgaggatttagaaaaattcgccaaagccttgcctgatttagtcaatatcggcgtggctgtgcctgaaagttgggtgcgggaaaaattgggtattcccgaaccgcaagagggcgaagcgattttaaaaaccgttcaaagcgactttaaagaagagttaaatgatgatgaaaaagaagaaaaaaccgagcaaaaacgcaccgcacttactttcagccctcacactgactgtggttgcggctgccgccaaaccgccttgtccaccgaaaaccaaagcacggacgaacagcagattttagataatgtgctagatgagggcttgcaacaggtggattttaacgcccaacttgatcctatggtacaaaaagccgtggcgttgatgttgagttgcgaaagttatgaggaagcgggcgagaaactggccgaggcttacccagatttagaaagtgacgaacatcacgcttatttaagtcgtgcgttatttttaagcgaattattagggggcagcaatgcccgccgttaattttgctttggggcttgagccaaaagaagccattgcgtttttgaaaggcaaaaaagctttacttgaccatttggacgagaaaggcttgctggaaagtgccagagccaaagccacacgcattgcgaacatcaccagccttgaaatgaccaaagatatttatcaatcgctgatcatcgctcaagagcaagggcaatctttcggcgagtggaaaaaaggcatttttgaacacttcaaaaagaaaggttggattgcgggctatgacaaaggctatttattggctgatccaaaaacaggtgagttttttggcacaccaagacggcttgaaaccatttaccgcaccaatatgcaggcggcttactcggcacagcgttatcagcaaatgcgagataatgtagatagtcgcccttattggcaatatagtgcggtcaatgatgaccgcactcgcccaagccacagtgcaatgaatgggttggtgtatgcctatgatgatccattctggcataccttttatccgcccaatggctttaactgccgttgcacggtgattgcgttagcggaaagagatattaaacggcgtaacctcatcgttagccaaagcgaggggcgattggtggaatatgaacgcaaaatcaatcagcgagaaaccgagaaaaccacggcgtttaaggtgagtgaagatcgttgggtgatcaccgaccgagggtttgattacaacgtggggcgaacgagctataaacccaacttagacctttaccctgaaaaactcgctcaccaatttgccaaacgggaaatgagcggggcgggctttcaatgggattttcaccaatttgaaaaggaatttaaggcagctaaacaagccttaaagttaggcgataaaccgaatagtacgcaactgaccgccatccgtaaccaactacggcgggaatataaatttaccgcaggcgtattaaatgcggcagataaagccaagctcggtagccaaactgcgaccgtgtggctgtctgatgatacgttaattaagcagtttagtagtcgagaggggcaaaatttcggggctgaggagtatgcggtattgcctgagttgatttatgaacctgatatgcttttacctacaagagaaaagcatttccagttttttaaacaaattaaaggtcatagatatactgtggttttgaaagtattggaaaatgaggtctttgtgcaatcattcagaaaaatgagtgagaaacagtgggataaggcattgaaaggtagccactaggcagggctcgaacccactgcacacaatccccggtactctttcaaccgttcgtccgcgatcttcgagattcatcgcttttctagtggctgtgttgaatatacccttttttatttttaatgacaataggagatgcaatggaaacattacttaacgacaaaaattggcaggcttacttacccttagctttgagcctacaggaaaaagatgagattaaagccgcattgctgaaaaacatagcgcaaacccctgacagttttactgcgctatgtgaatacttaagatgcttacgcattattgaagaatatccgttaaaaacggaataagtaattatctatgctggatttgctcttggtatagccgtttagaaatagccaagattaattgagttaaatgctcggcggtttgctcaacctcttttgtatcattaggcagagtataattggggtgggtaatgagatcacgagctaactcaatagcgagtttatctgtattagtagttctttctattttcatcgttatttccttatttaaaatgggcgatattacccattcttagggtagcagaggcatattatgattgaaataaaaatcaataatgaaaaagaggtctttgcgttattggaacgcttaagccaaggtgtgcgttataacgcccctttaatgcgtaccattgcagggacaatgcaatcagcggtcgatcaaaactttcaggcaggtggtcgtcctaaatggctgggggtaaaatctcgctccaatggttcgcccttgattgatagtggggcgttacgcaatagcattcgtgccagttgggataatgatgaagcccttgttggcacaaatttagcctatgcggcaattcatcaatttggtggcaaaaccaaaccgcataagattaaacctgtaatgaaaaaagccttgagctttgggggtattgtgcgaaaatctgttaatcacccaggaagcaatattcccgcccgtccatttttgaccctaactccacaagatgaggcagatattttagaggacgtgcaagactattttaaacagataattaaataatgctatttagcccctaaatcgcacgctgtgcgattttttcttttagggggtacgatttatcattcaaaaatttttaaaataaattaaaacgatttaaaacggttttaaaatgggttgtgttttaaatcagtcagcttctttctatttttcagctatctctcttttccctctcctttctgttgtgtggaagcctattcacagttttagcacatcgcaaatcgctatgctatgtcaagattaagcaataaaggatttttttgatgaaacttgcagcctgtagttttgagttgagccaagccaaaaatgggcgtatccagttgttgccttacggtgcatttcgagccacagacggacgaccttttgacgtggaggcttggtatgtaacagacacaaacggtaacgatgtggtggcattggcaaatagccaacgcaacccactcccaattgattacgaacatcagattttgcactcacaacaaaatggcaaagaagcaccaagtgcggggtggatggattacctctattttaccccgcaaggtatttttgccgatgtgcgttggacggacaaagccgccgactatatcaaaaacggggaatatcgctatatctctgcggtgtttagttatgacacgcaaggctatgtacgcaaaatctttcacgccgccttaaccaatacacctgctttagatgggatggatgaggtgatggtggctgccagccaacaatttttaaccaaccaagaggaaacaccaacaatggataaagccttacttgcggcattgtgtgcgttatttaacacgccgaatgccaccgaagctgaaatcagccaaaaaatcaccgcacttgcacagtccaaaggagatagccaagtggcgttatcagaggtttacatcaagctcgctgaaaaagagcaatctgttgtggcattgaccgcacaaattgccaaccctgaccctgctaaatttgtgccagtggagcaagtcgctgccttaacggccgagttcacgcaatttaagcaaggcattgagcaaaaagaaaaaaacgcattaattaccaccgcactttcgcaaggcaagctcgctcctgcattaaaagactgggcagaaagtttaaaccttgcagcattaacggattatttagccaaagccccagcgattgccgcattaagtggcgaaccacaagccaaaactgacccgaacgaaaatcaagtggcagccttaagtgcggaagataagcacgttgcaaaaatgctgggcttaacggacgcggaatatcgtaaaaatttagaaacaggagcttaaccctatgagcgttgaatttaaaaaatcagaaatcttaaaaaaattagatacccaatttcgggcggaatttagcaaaggaattgcccatattcaaccacaatacccgaaaattgcgatgactgtgccgtctaacaccgcaaccaatacctacggctttatgcgtgcgttcccgaaaatgacggaatgggcaggcaagcgtacgattaaaaatatgtcagcggtgggaatgacccttgataacaaaaaatacgaaagcacggttggcgtaccacgtgaagccattgaagatgaccaagtgggcttattccgcaatatgatggctcaagcagggcaatcggcagcggaattgcctgatgagttgatctttaaattgttgcttgcgggtgaaagtacgctctgttatgacgggcaaaacttcttcgacaccgatcacccatactatcaagatgtcgatggcacgaatgcgggaacagcacaaagtaacattaccacaggttctgatagcggtgcgaaatcttggtatgtgctagataccaacaacgtgatcaaaccgtttattttccaagagcgcaccaagccagagtttgagggcaaatttgatccgtctaagtcagataccgtgtttatggaagatgtgtatttatggggcgtgcgttatcgctgtaatgcgggctttggtttttggcaactcgctcacaaggcgaaacagcttaacttaactgcggataatgtgatggcggttattaccaaaatgaccaccttaaaagccgatggcggggcgtttatcaatgtgcgaccaaccacgcttttagtgccaccaagtttagaaaaagcggcgttagatatttgtaacgctgatgtgattggcggcacaaccaacaccttaaaaggtcgcttacaggtaatggtatccccttacattatcgaataatcatttttccccgcctgcgggcggggcgttaaggagaaggattatggcaagaaaaaccaaagcccagaaagaaaaaacggaagcggaaaaagaaaacttagaagctaacgtgaaagatgacgcattaaaaaacgatgctgaaaccgaccgcaacctagaagatagcacgacagccaaggcagaagatgagacggtaaaaaacgctgacgaaactgaccgcactttagaagagggtgcaacagccgaggcgggcgatgaagcattgaaaaacaccgctgaaactaactgcactttagaagatgacaaggtggttgaaggtgggcaagtgattaacccgattgcttatgctgtcaagttgcgtgccattcacccgcacgacagctacgggcgttgtggttaccgtttttacaaagacaaagaaacggaaatcccagcgaacgacttaacgggagagcaggttttaacccttgcggaagatccgtggttagaacttgtgccagtgtgtgaggaatagcgatggcttatgcaaccgttgccgattttgtcttgcgtgtgggtgagttacaagccattgagctgaccgaccgcgatggcgtgggggaaattaatgagcaggtgttagaacttggactagcggatagctcaagccagatggacggttatttgtcagctcgttatgccctgcccttgctctccgtcccacaaaacttagtgcggttgtgttgtgatttaacccgctaccgccttgccagtatgtcgggagtggatattactgatgagattattgagcgttacaagctcagcctaaaagagctggaacagctagctaaaggagctatctcattagggttgccagagcttaatgcagacagtgaggacagcgagttttcaggggcgatattttttagcaacaataaaaacagggtatttagccgtgataacaaagattgaacaagccttaactgaccgcttgcaacgaggattaggcaaactggttaatacggtgaaaagttatggcggtgaatttgatgatgagagctttagcacagctcggctacctatgtgtttaatcacttatggtggctctcgcattgaacgaaaagccactagtgcaaagcgttatcaatccaccgatacctttgtgattatgcttgccgtgcgttctttgcggagcaatcaagccgcccgtcaaggtggcgtggataaacgcgaggtgggggttaatcagctcattagtgcggttcgccgtttgttagatagccaaaccttagggggattggtcaaaccgcttaagcctacggcagtgcgtaccatttttaacaatgccaagtttaacgcgagttcaattactgcttatgcgttggaatatgaagtggtgtatgacgatgttagcccgttagaagatgggttatatcccgaacctaccaccgatgaaaccagccctgattatgtgtttagcgtttatcagggggagcaatccgatcctgcaccgacattggaacatattaattttaatctttacaacccagatactaacgccgatcacccttttgtggtggcgatggaggaaaaatgaaagtaaaagccgcagttggcattaaagtgccaatggaaaatcaaccttaccgctatattgagcaagagccagtggaggttgaagacagtatctattatcaacgtcgcattaatgacggggatttaatcgtggtcaatgaaccgcgtaaccgaagaaatcgggaggcaaataatgactgatactaatatcgaatttgagcatattccaacaagccttagaatgccgggtgtatatagcgaatataacgctcaaaatgctgtgagtaccttaccaactaatgagcaaaatgtattgattattgctccaatggtcgggggcgatacggcttattctgcccctgtgccgatttattccgatattgatgcgaaaaatgcttttggggcaggttcttgggggcatttaatggctcgtattgccattcaaaacaacccgatgatccgtttaacggcaattggcttaaaagataatagctcaggcgttgcggcaacaggaagcttgaccttaaacggcacagcaacaggtgcgggcgtaattaaagcgatgattggcggggtggaatatgccatttcagtggcaaaatcggaaaccgccagcgacttagccacccgattaagtgcggtgatcaacgcgggtgaatattgccctgttacggcatcggtgagtacggcaaccttaactttgacagcaaaatgtaaaggggaaattggcaatgagattgaacttagcgtacaaagtactgcacaaggcatttcagcggaagccagtgcctttgcgtcgggttcgcaaaatgccgatcttgcccctgcacttgccagtgtggcaggctcgcattatcacattatcatctcgccgtttgctgatgataaaaatgccaccgcacttcgcaatcatcttgagcttgttgcaagtccaacggagaaaaagcctgcgattggggtgctgggttggcgtagcacgatggcagccggcacaacctatgcgagcaaaattaatgccaaccgtatcacttgtgcgtggtacaaaggggcgcttgaagcaaatgctttacttgcagcgggttatggtgcagtcattgccagtgaggaagaccccgcacgtccgctcaacaccttagagttgaaaggcttaacccctgttgatgccacgcaaacgccattaaaaaccgagattaatcaagccttatttaatgggctaacaccgattacggtggtaaatcatcgggtgcaaattatgcgggcgattaccacttacaccaaaaatcctgccaatgtggacgaccccgcgtggcttgatttaactaccattcgcacgatggactatgtgcgtaaagcggttgaacagcgtgttgccttgcgttttccgcgttcaaaactgtctaaacgcacaccgccaaaagtgcggtcagaaattttagatgtgttgtatcgcttggaaaaccaggaaattatcgaaaatgtggacgcacataaaggcaaattattagtggtgcgtaatggacaagacccaaaccgcttggatacgcaaattccaacggatgtggtgaatggcttgcacgtggtggcaaatcgtattgatttaattttataggagtaagtaatggctgaaaaatatgcaggctctgcggtgttagaagtggacggcgtagagattgagattgccgatctaaacgtaaccaaacaaacagggcgtaaattggtgaagacaatgaactccgaagggcgtgctagaggctttgccaaagggattgccacttgggaaatcagtttaaccgcagccctcccaattgatggttctgaaattgattgggcggaaattagtgatgccaaaatcactatctatccccttaatcaagaagataaacgtacctcttatttgggctgtttcactacgcaggtgggggaaaaatacaccgtagataatgaagctgtgattgatattcagatgaatgcacttaaagaggtgagcgaataatggacggacgtttacttttaggcttgcccgttgatggtaagcgatattttgattttaaggtgcatttgctcacattgggcgatgagtgcaatgcccttgagatgattgcgaatcttggtattgctacaggtgaggctaagccattaagccaagcagaaaaaatgctgatggatttagcctatttatgccaacaagtggaatttgttggggtggataaacaatatattacccctgaatacttgctaaagcgcctggcaacagatgattatctcctgattgctgagactattttggcattgcgaaaaaagcatatcgccgctggggagagccaacaccaagaaaacagccacgccccaactgctatgacttaaaggcggcagagcaacattatcgaagtgcggtggtttttttagcgaaattaggctttacgccccagcaggtgcgagaaatgagccatttagaggtgtcggcttgggtggaaagtctgttgcaatctcaaggggcaaaatcacaagcgaatggcataagcaaaggcgatacggtgcattacaaccttgtacgccgcaggcaacaacaagaggcgtaagcctcttttttttatgggtttaaaacaaatttaataagggtttaaaaatggcaaatctaaaaatgtctttatggcttaaagctaaagattttgcaagtggcgttgtcgataaaatgcgtagcaatgtcaataaagcgaataaagatattgaaaatcaagcggtgcgaagcgggcaaaaacagcaagaaaccgtaaagcgtacggctcaaattaccgagcaatcttatcgccaaatacagcaagctgctcgagcaaggcaaagtttgggaatgcggagtgaaaatgctatccagcgtgaaattaatcaaaccattgccgcttatcaacgtttaaaaaccagtggtgtcgcctcaagccgagaaattgcccgtgcggcggtaatagctaagcaaaaaattgcccagcttaatgcggaaatgggcaaagtgtcgacagggcaacggttggggaatgttgttggaaaaaccatggctattggcggagcggtttatggcgtagccagtacattaaagcccgcaatggataataaaaagcaatgggatcagaatgttgctcaagttgcattaaccgccttcaatgatcaagatgcggattatatcaaaacaacaggtatcgcacgcgtaaataaagcagcatatgaaacaaccaaagccgttggtgcgggaaccacggatatggcgttatccgcattagatggaatgattaaaaatggtttatcttttgaccaagccgaagcaacattgcctacagcaatgaaaatgatggttgcgggacaaacagacggtaatcaagtgggtgcacttcttcaggtcttgaaaaattatggctttaagggagaggatttacaaaaagccttagaggttactttgcaatctggttttgatggtaagtttgaggtgtcagatatgatccaacacctacctaatttgctttctatttctaaaaatgcgggctttcacggtttagaagattacaaatatttactttcaatgacacaggtggcagctaatcaagcggggtcaaatgatattgctgctaataatgttgccaactatttgaataaattaaatagtgtcgataccgcacaacggttaaaaaaagtggatatttccaataaaaaaggtttgcaaggcattgatttagaaaaatcctatcagcgtggtttagccagtgggaaaaatgcttcacaggtaatggtaagtattgctgaaacgttgcttaaaaacgatcaggaatatgtgaagttacagcaaaaactgttgcaaaccaaagatgaacagaaaaaagagcttatcaaagcccaaatggatttaaaaaaaggggcggtgcttggtaagttgttgcctgatgtacaagcaaaagcagggtttaatgcggtaacaacccagcaagaaatggataagtatcaagccaatcttgaggacggcaaaattggcaaaaatatggataaatctgtcaaggtgcttgctggaacggatctagctaaagaagagctagccaattccttaaataaatttagtcaaggcgaagtcaccggctggttaaatagtattgaacgtaaaattaatgacgaagtgatttctgcacatcaaaacggcaacgggcaaatggtgggtaatttaggcttagcaatggatgtgggaaaatcagcagtgggctatggttttggtggctgggcgttaggaaaaggattatctggcggtttggggcgagcaggcgttggtgcggcgacgggagcaggtttaggtgttgtacccgttttaaaagcggtaggtaaagtgggcgttgttggcacaatcgcaagcttaactacatcacctgaattagatagtaaatctcaacaacttcttgatttacaacataaagtacgttcaggaacagccacagaggaagaaaaacaagcgttaatgcaacaaattaaccaatctagagaagaagcaaaattacaagacgcactttataacacaggtaattcacttggtgcgtattttacccgtaaaagtgtagaaaagtcttatatggcttatctcaatagccgtttggaaaaaggtgatatttcggaagaggttcgggctcaaattgaagaacgaaatgcctattatcagaaagagcaggcaaattcatttcgttttcgtaaaggatcaccttatgttgcttcttctcattttagtgagcaagctgatcaaagtgcgactcgcattgcaggccttagctcgcctatcggtttgacaatgccaaccgcggagggaggaacacttgcaaaacttgagcccgccttgtcgaacttagccaattaccgagctgactttgagcaatttgggcaaaccttgagtgatgccttaaaacaagccattgagagccaaaattttgtgatccaaaatcaaattaaggtggatttagatggacgaattgtggctgaacaaacttcagaatatcactatcaagatttaaaacgttgggggtaaaaatgaaaggttggacaatgcctattcaacgcgccagttatcgtggtgtgcgttttgaggtgatttcggtagatgatgaattaaaccgtgccaccattgatcacgcctacccttttgttaatggggcggatattgaggatttgggtttaaaccctcttacggtacgaatgcaagcagtgttttatggcgagggctattacacggatttcaagcagtttttaagtgcgttacaaaaacaaggggcagatgtgctagtccaccctattcggggtcggttgccgaatatgctttgcacttcggcaaattttcgccacgatgcggaaatgattgattatgtggcgttagatttaacttttgtagaaagtacacctgccaagccgatttttgtttttgagttttcttttttggctaaaattgatgaacttttaacacaattggaagattttattgatgaggtattagcgttttttgctcaaatcatggaggtggttgcctttgcgatgaatgtaaaatcacgtttattaggggcttttggtgcattacaaggttgttttgaacagctttgtggtttatttgatatgggcaaaacttttttttcattgccttctacatttggtgcaatggattttaaagcaaaatcttctcataccgctaaagcaattacacatattatagagcaagggctaacccaagttgctcagcgttctgatctcacaactaaagcaaaatttgatgaaacaataagaacggtaaagcaaattcaagccattcctcaaaatttactttcaggtaaaaatatgaatttatcgcaaaaacaggggataaaatcattaacaatgtcattgtcaactgaaagtattgaaccagtgcatttgttgatgcaattaacttgtacagcgacgttaattcatttggcaacggggtttattgaagacgaaacattattgccgcaagagattgactatattacaacccttataaggactcatattgtgtcaaccttgcaattattgcgtcatcaagcccaaaaagagcaagcaaattctgcactaaattcaaccgcacctaatactggggtttataccgctactcagcaaattgcggagagattacgaactttatcccatcattttacccagcttgcaatttcggcgattaatcgtaaaccaccattaacggttagggttgtaccatttaatggcacgattcaacagatcgcccatgcgttttatggagattatcgccgttccgatgaactgctacgcttaaacccacaagttaggtttccgaattttattgctcagggggagttattaaatagttatgtcaattaattatccttatgaaaatgatgtggtggttgaaattgcgggacagcagcataaccactggaaaagctatgacattgacagtgattttttaatccctgcggatgcctttcgttttgaaatcggcgtggcttcagagcatacccacttacccgatttttcggggcaagaagtaaaagtgcggatcaatggcgaggtggtgctgacgggcattgtggacaccacccagcacgggattagcaaaacgaaccgcacttttagcctaaatgggcgagataaagccagcattttagtggattgctctgccccgataaccaatgtgaaagggctaacggtgcttgaggcggtgcaaaaaattgtgaatccgttgggtatcacaaaggttgagcttaacgccgaaaataatcccactttagataaagtcgatattgaagtgggcgaaaccgcgtggcaggctgctatccgttgtgctaattctgcggggctacatttatggtttgatgcccaaggtacgctaattgtgggcggtgcggattactccacaccacctgtggcaacgctatgctgcctaaaagatggtaaacgcaataattttgagcaagcagagttgacctatgatgtatcacagcaatttagtgagatcacctttttagctcaacgccacgggcgagctggggacgataataaaaacgatttaaaatgggtgtacaaaaacgaggcgatgaccacttataagccgaaaacggtggttgtgcctgatgtggaaaatttggcagcgttgcaaaaatgggcgaaaaaatatctctcagacagcattttagaaggctttacgctaactatcattgtaccagaccataaaacccaaacggggcaattatggcaaccgggtcagcgtgttcacgtgatttgtgaagaatatgatattgatgccatctttttcttgataggacgacgttttaccctttcccgttcaggcggtacacaaaccgaattacgcttaaaacaagatggagtttggacacccgatgcttatgttggcaaagcggaaaaagcccgcaaacggaaaggtaaaaaaggtaaaaatgggccgttaatggcaacaacaggtgatggtaaatgggagatagttaggggtaaataatgcgtcgatttagtcaagcaatacaacaaaccgcacaaacgacattaaatggcgtgcgtcaggcttttcgtggcgtgctaaatttagtaaacagtgcggataatattcaaaaaacgcaagtatcagggctagctgacgagaccttgcaagatgtggagctaatgcagcattttgggtttacctccgttcccccagctggtacgcaagcggtgattattcccatcggtgggcaaacctcgcatgggattgtggttgcaaccgaaaatggggcgtttcgggtcaaaaacttgcaaggcggtgaggtggctatctacgaccaaagtggctcaaccatcgtgcttaagcaggggcggttaattgaggtggattgtgatgattttgtacttaattgcaaaacctatcaagttaatgcgacaacgggggcaaattttgatacgccaaagttagagaccacgcaagttttaaccgctcaagggaaaattaatggcaacggtggtatggcggtgcaaggtggcagcggggcaacctttaacggtgatgtgacgcaaatcggtggtaacattacgactgatggcgatgttaacgcaagcggcaagtctttggttaatcatactcacagaggggacagtggtggcaataccggctcaccacaataaatctatttacaacaataaaaagcggtgtggaactccatcaccgctttttttgtatctgttttacgtatatttgtcagtatggacagagagttaagcccgcttactggggactatacaagtaagacaatcagtacgctcgctaatgcggcgtatatcagattaaccacacctttaggctcttggtgggcagatgggcgtgtaggctctctgctccacttaattcagcgtgaaaaagacttaacccgtgttggacttatcgcccaacaatacgccgaagaagccttacagcccttgcttgatgatgggcgagcaagtcaaatccaagtaacgcaccagcaaccacataatggctggttaattttacatattgaaatcattgataatcggggtgaaacatatcgctttaaacaccctgtaaaagtcatttaacgggagtttaaaaatgtttgttgtacccaccttagatgagataagagcaagcattttacgcgatatgcaagcccttgatcctcaagccgatgtgagcgtagacagtgataattacgcccgtgcctcaagtttagcagcggtggctgaaggtatttatgcacatcaaaaatggctgattaaacagttttttccagataccgccgatacggaatttttagagaaacacacgggattgcgaggcattcgccgccgtaatgccacctatgccagcggacgaggggcaaccattacggggcaagaaaatgccgagatccctgcaggattgcaaataaaaacggaagataaccgcttttttgagaccctagaaagtgcggtcatttctagcacgggttttgtggttgtgcctgttcgctcccttgctacaggagcgggacaaaatattaaaacccaaaccaaaggcagttttatggctgccccagttggtgtgcaaagtgaagtgatactcaatgaagtcattggtgcgacggacgcagaaagtgatgcttcactgcttgagcgtttgcttgagttgatccgccgtcctcctgcaggaggcaataaatatgattatcgcaattgggcgttatccgttgatggcgtaacggcggcttatgtgtatcccttgcggagaggattaggcacggtggatattgccattacggcagacaatgatgtacccaatgaagaaaccattcgccgaacacaagcctatattgatgatgtccgtcctgttacagcgaaagaaagcaaagtggtaaagcctgatgtaacgaaaatccattttgatattcaggtcaaaatcagcggcattacgcttcaagagataacgtcagcaatacaagccgcattggctgattattttaatacgctaatccccggtgatagcttgattgtgtcgcaatgcgaggcagtggtgaataatttagtgggtgttgtggatcgcaaatttattaccccaactgcgaatcgtaccgctgacgttacccacaaaattgagtggtttagattggggaacgtgaatgtgtcggagatgcactaatggctaatgattacaaacacgcccttgctcagctctatccgcctgtttcctacaatattaacggtaaacaatttttagcccaatgtgaggttgatggaaaggtttttcaacgtttagaacagcgtgcaacggaagtgttaaatgtgattaaccctgaaacttcggggcaaatgctcgctgattgggaacggatttgtggaataaaaaccgatacccaaaagacctacactgagcgagtgaaacgggtcattttgcagcttaatgccattggtgggttgtctatcccctattttatgcaactggctcaaagcattggctatcaaattgagattaaagaattttcaccattgcaacaggatttgcctgttcccggtgacattgtgcaatttagagacgaaccgcaagaaagcctgatttttatgtggcgagtttctgttttaaatggtgatgacaatattgtgtattttcgagcggggcagtctttagcgggtgagcgactagttgagtttggcgatcccattattgaagccttttttaaagagttaaaacccgctcatacttactgttatttttcatacaaaggttaaaaaatgaaagatttactccctaaaattgatagccaagatggcgaatttcaaaatggcgacccagccagtggcacacaaggcacgcgggtaactgccgaatggttgaatagcgtgcaggctcatttgcgagatgtaggcgaagaggtgaaatatttgttattacaagcagggcttacacctatcccaagcaaaaccacacaaatttatgaagcgattatggcggttattaatgccaaccgcagaaatggcaacacaacccaaaaaggggaaatccaacttaccgacagcatcaatatggcatcaagtgtgtttggggcaagtgcgttggcagtaaaaaatgcctatgacaaagcggttgaggcggataatcacgccgaaagggcttgccatttggctgaaagcaagcaatcccctgccacaacattagccggctatgggattggtgattttaaggtggggacatccaccggtgatgccaatgattgcaagattgacggcaattattattttgccagcgggcaaaatttaccgagtgcgggggcgtggcatattgcggtgatgagtggcggacaaactaacgctatccgacaaattgcccgcaaagccaatgagagcaaggttcaaacccgttattttaacggcacgtcttggagcgcgtggaaagatgtaggcggtgatggcttgcccgttggctcagtgttggcatttcctgtagccgtgcaaaatccacaaggttttttgaaatgtgatggctcaacctttgggagaacaacctatcccgatttataccgcgcgttaggcaatagcaacaaactgcctgatttacgccgctctaatgtsggwatgacggcgtattttgcgacagatraratyccwratggytggrttgmgtttgayraaatcarrsamgaagtaacccaagaaaaataccctgagttgtataaatacctgattgaaaaatataccagtatagacaacgtccctaaagcggaagaccgttttttgcgtaatgctcatrrtgrgttramrgtwggagatgtacaactyggttcsttaatcggtrcrgattcgayagacggaarcggggcattttcgccttatgtgaaagctattmaaarcacttaccaagaaaccgttgaccaagtaggsttcgatccgttgctgawagrrgamattggaaacggaagarscgytgtyaataacgaacattcycckgacrgcggacaacctgaaaccaaaaaacaatayaacgcygggctttcgtggtcggtaggarcggrcaraaatrmwgacctkaatsamccwatymaaaataayarwastggcaacggtcattttgtcggygtwacycgyccraaatctcttgtwttaaaactktgtatyaaggcgaaaarcagttttgatgaggtkstrttttggattaargcrttyggtgcggtggaaaatcaaggtgttttgraygcctctgctatcgttcaagawatgcaggattttaaacrgcaagccgaggaaaaaatacaatycattacmktgcagaaagaagagattatgcacgcyatacaagaggagatggrraaatcagattattcccttgttaaggtttgggaggggaagaatatatatwcwgakggktcaataaawttaagtgaaccttgttttggctctactgtttttctgtttgcttacgctgatagagacyatccaagggaattagttgtttttagttttgatgttcctgataaacatattgatttaaaaagaaaaaattcagatcaatacacattctatggtatkgctcattacacaagaagcggtggtcatratscatctcttacacatrctaagattaacattaaccgaaaaacaggagatcaaatcaaatttgaggatttttatgcgggatataatatttacttaagagaaatctatatcaaaaaaccaaacaacaggaamscamsatgaacatttactttcaaaaacaacaattaagmaattatcaaatttttccaatccctcaggatgtagagaattggattgaaaaagacgttgaygaaaaggaactggaaacgcatgtwttggtggaatttaacggcgaktatcaatgggtcgagaaatccgcygacccgatgacgaaatggaacgggaaaacatgggtcgttgatgaagagaaaatgaccgcacatttaacccaagtgcgggcggaaatgcgagagaaaatcaatgccttgcgagatgaaaaaatcaatggcggggtgtttgtggaagcggtgggcaartggattgatacggacgctacggcggagcggaatatyttatccgtcaaagccagttatgatttattcggtgatatggarattgcgtggacttgtgcggataackckgtwttgatgatwaayaargaaaaattaatgctgatttggcangcgttaatgaatgctaaaacargtaatcatgckaatgccttgaarcataaaaccgcyatggagcaatcggacaatccggcggaatatgattattccagcgggtggacamartgttatcasgattatttgaaggagcaaggcaatgagtaaggtgtatttrgctytgtacaaaggcacaggcggtagtctctatgaccgakttayrgattggcttatycgtmamatcacgaaggggcaatatagccattgtgaaattgccrttgagcaaacggcgtttttaagtggcgattattatccgtatatcacctacgattgctacagttcaagtcctcgtgatggtggtgtgcgacacaaagtgattgaccttaaagacggcaaatgggacttgattgaactgccaaacatcacggcagagcaggtcaaacgctactatacccaaacccaaggcagaggttacgattggtgggggatgttggggattgcctttggtatccagcaaaaacgctcacgctacttttgctctgagtggtgttttaacctaatcaaaaatggtgacgagggctggcggtttagtccaaatcatttagcggcgatttttagacggggagcaaaatcagattattccgcacgaagttgatattatttgggaggggcaaaatgaagtaaccgtttagagcaaaagaagaagcggcgatgtggtaggctctgacctctaccacatcagcctaagcagatagtgcctgcatagacccgagaccgctttgtctgaccagacgggcggattgtaacaaaaccgcgtaaagtgagaaagtctatgcaaaaagatttgcaagaaatacggtgcaagtgctgtaaaaagcttcttgcacgcacaaaagataatcaatatttagaaattaaatgtgtgcggtgtaaaaccttaaacacatttaaacctactcgttaaacaactcagagtgtccgaatgccttgagcgtcagaacgccataatttaaggataaattatggcaaacaagaaaatcattgtttgggcgttatttgatagcggcaatggctgctatacccaagccgcccaaccattccctaacattgaaatctatcctatcggcattgatattgagcgtaaaaatcggcattttttaccgctgaatttagcggattttggtcggttgtttggtgataatacgctgtttaatcagctagatagcctccctaaacccgatgtcattttagccagtccgccttgtgagagtttttccgttgccaactctattaagggcgggaatgtctgttggcaatggcagggaaatacacgctttgctattcgccgtcgcaaagattttgacgcggcagcggttaaaaagcgacgttatcgttatgagacctcttttttgaatcgaattaatggtgagctttgcatttataacaccattgagattattaaacggtatcagccgaaaatttatgtgattgaaaacccttatgcgagccgcctttggcactatcttgatgagattttagcctttcctcttccttatgcgaaccctacctattatgggaattatggctggccctgcaaaaaggcgactaagtttaaaagcaatattccgctaaatttgcgttatcagcattatatttcgggcaaaacgatgtttgactgtttacacagttataacgcccgttcagccattccgttgccacttatccacgatatttatcgtcgtattattgaggtgttaggaggtaacgatgcgtcattttagtcaagcaccgttgccatttgtcgggcaaaaacggctgtttttaaacgcctttaaacaggttttaaatgacaatattcaaaatgatggcgaaggctggacgattgtcgatgcctttggcgggagtgggctattaagccacgtagcaaagcgaataaaacccaaagcacgggtgatttacaatgattttgatggatacgcagacagactaaaacacataagcgatacaaatcgtttacgagctgaactgattcaaattgttggcgatattgtaccaaaaaacaagcgattagacgacaataaaaagcaagaaatcattaataaaatcaatgattttaatgggtttaaagacctcaacaccattgcaagttggttgcttttcagtgggcaacaagtcagctcatttgaggagctatttagcaagacattttggaatggaataaagctggctgattatcctagtgcagaggattatcttgatgggcttgagatagtcagcgagccatttcaacagtttctgcctaagtttgccgacaaccctaaagccttgtttgtgttagacccaccttatctttgcaccaagcaaaacagctataaaatggcaaattattttgatttagtagattttttgcaacttattggcctaacacgaccgccttatgtgttttttagctccactaagtcagagtttgtgcggtttattgcgtatatggtgcaggcgaaaaaggataactggcaagcctttgatggagctgagcggatagtccttcaaacatcgttaaactatcaggttagctatgaggataatttggtgtttaaattctaaaaattaaggggcgaacgcccctatttttcaatgcccgccttatagcctgcctcataagccgcacgcatgaggcgtttgatattccacacgcccatatcataaaaatctaaatggtcactcattcgggtctctaatgtttcaatatcccccacctcttttgcaatggtttctaatatttttgcgatggttttttcagttgtttttttcattgcttattctcctcttaaaatgtttacgattttgtcagcgatttgctgggcggcaatgtcaaagttagtctcgattgaaacgcgttggcgacaatgttcagagtgttcaaccagcgtgccttgtggcatataaagtaaataaattgttggctcattttgataactatcttgacagacttgaaagcggcgtttcccttgcacaaattccccatttttaaagccgtgatggttttcaagtctggtggttaagtgttgaataaatgctcgtgtattaaatttcatttttatgcccctgttgttttgtgttggggacatcattgctcgttggggacgaggagtaaaggggaaataagcagtagttaagctgactgactaacaatgtagctggggaggtatggaggtctaaatgataaaaaatttgaaataattttgcataatctgagactcaatagctatgcaaaataaatttaaattttatgcgaaatgttttgcgattttataatttctccaattgttaaacgtggagacagtgaattgaaaggatcttgaaaaacaatctgcatgtcttttttcaatgcttgagctttttctttcgataaagtggcgatattttttccgttaaattgtaatatcccctgataatcaagaatttgcataatagcacgtcccaacgttgatttacctgaaccggactcaccaacaataccgagggtttcaccgacttttaactcaaaagaaatatctttaacagcatggaaaacatttttcggtttaccgaacaatgtgcgttttagcacataatcaatatgaatattttgtccattgatgaggacaggtgcattttcagccaacggatgttttaaatccgtagggataggcgtcagtaattcttgtgtatagggatgatgaggttggttaaatacttgttctgtattacctcgctccacaatttcaccgttttgcatcacacaaacgtaatcactgtaacgacgaactaaacgcagatcgtgtgagatcaaaatgatcgccattcctatatctcgttgtaattcaagcattaaatcaagaatttccgcttgcgttgtgacatcaagtgcggtcgtcggctcgtccgctattaataaatccggtttattaataattgccatcgcaatcatgatacgttgtaattgaccgcctgaaaattcgtgtggataacatgccattttcttttccgcttcgggaattttcacttttttcagcatatccaatgcgtgcttataagcctccgctttactcattttcggatggtgaatagcagtcgcttccgcaacttgttcaccaatcggcaaataagggttgagtgaagtcatgggttcttgaaaaatcatcgccatacgatcaccacgaattaatcgcaactctttttctgataaagataatacttctttgttttcaaataagatttttgagtcttcactgtaactgatgattttttgcggcaacaattgcataattgccatagaagttacagatttaccggatcctgattcgcctacaatagcgagagtttgtcctttttctacctcaaaagaaatattacgaacggcgtgtacgacttcttcatctgtttttagataaacatttaaattttttacatcaagtaatttcattctattcattcctatttatcttttggatcgagggcgtcacgcaagccgtcaccaataaagttaaagcaaaataatgtcagacaaaggaaaaaagcaggaaatgcaatcaaccaaggcgatgtttccatttgtgcagctccatcgctcagtaaggctccccaactgctcatcggttcttgtgtgcctaaacctaagaaactgagaaaagattcaaataaaatgagcgaaggtacttccaacgaggcataaacaacgacaattcccaaaacattcggaataatatgtttccaaataatttgacgacgggaaacaccacaaacaatagcagcctcaacaaattctttgttttttaaactgagtgtttgcccacgtacaattcgagcaaggtttaaccaagcaatcataccgatagcaacaaaaattaagaaaatattctggccgaaaaatgttaccaacaatataacgaaaaacataaaaggaaaagaactgagaatttctaatgtccgcatcatgacaacatctacttttcctcccacataacctgagatagcaccgtaaatagttccgatcatcacagcgataaaagcaccagcaatgccaaccatcagcgaaattcgcccacctatagcaatacgcaccaataaatcacgtccggaagcatctgtcccgagataatgcccggaaacaaaatcaggagcgatactcatcatattccaatcagtgtcatcatagctaaaaggaattaacattggtatgaaagtaataaatagcaacatgcaacaaatgacaatcaagctggcaactgctgctttattacgaaagaaacgacggcgtgcattttgccataaactgcgtccttcaatgacgctctcacaagcgttttgcatgatattttcttccgattttgagcggttttgacgattagacaacatgagatctccttatgaatagcgaattttcggatcgataaccgcatatagaatatcaactaatgcattaaaaaagatggtaagcgtccccactaatatggtgaggctaagtactagagaataatctcggtttaaagctccattgacaaacagctgccccaatcccggcaacccgaatacactttcaatgaccattgaaccggtaataattcccacaaatgccggtgctaggtaactgataacaggaagaagagccggacgcaaagcatgtttgaaaataatttttttcaatggcaatccttttgctttcgctgtacgaataaaattggaatgcaatacttcaatcatggaacctcgtgtaatccgcgcgataccggcaacgtaaccgatagtaagagaaagaacgggtaaaaccatataataaagttgaccgtcgttccaaccgccggcaggtaaccactttaaccaaatggcaaaaaataacactaaaagcggtgcaaaaacaaagctgggcatgatcacccccgtcatcgcaaaccccatcacaatataatcccagcgactgttttgtttgagagcggcaaatgtgcctgcaactaagccgataatgactgagaaaataaatgcgacaatacccaatttcagtgacacgggaaacgcagaagcgattaaattatttacgctttgatctttgtatttgaaagaaggtccgaaatcaccttgcgagagatttttcaagtaaagcaaatattgtttaaagagcggttcatttaagtgatatttcgcttcgatattcgccatgacttctggaggataagtccgttcggaagtaaaaggactacccggagccaatcgcatcagaaagaatgaaaatgtaattaaaataaacaatgttggaagtgcttccattattcgttttacaataaatttcaacatcaagaactccaaacagattaaatgagaaaaagtaaatgttatttaaaaataaatcgtcaaattcccctaacctaatgttatcaattagggaaatttgacgggataaataagtttaatgtttaataatataaagatttctcaataaaataatatcttgaggatctttaccttcatagcccttaacataaggtttcaccaaacgcgggttaacatagttatatatcggtatgataggagcatccgctgccaaaatcgcttcggctttagcataagctttcatacgatctgtcgcctcggagaattgataagactcattcaccgcttggtcgtaggccgagcttttgtaaaacgctaaattgttacttgagttggagagaaaataattgataaacgttgtagcctgattgtagtcagccgaccaaccggcacgtgcaatatcaaattgtttgttgtgacgactttcaatatacgttttccattcttgattttccagtttaacatcaactaaaccacccgtattatttttccaaattgatgccgcggcaatagcaacttttttatggttttcattggtgttatataaaatggtaaatttcaatggattcgatttactgaaaccggcttctttcaataattgaacggcttgctgattacgctctttcattgataatttagtatattcaggttgctgaattgcaccaccttccgcaatatagttcggcgtaaacacgtatgtaggtatttgcccttgccctaataccttatctgtaatgatattacgatccaacgctaaattcagagctttacgtacccgtaaatcattaaatggtgctttcgtattattgatctcatagaaataagtacccaatgtacgtgaagtaaacacttgatccggcatttcagcttttaattttgggaattgctccggtggtaatgcatgatccgttatttccacctctcccgcacgataacgttgtacatccgtacttggattttgaatcgctaagaatgtcgctttatcaatcacggtttctttatcattccaataaagcggattgcggacaaattcaattttttcgttgataacgtgtttcgtcaatttataagcaccgttacctacgtaattttctactttgacccaagcatcaccgaatttctctacaacatgtttaggcaaaggtaagacagagtgatgtgtggtcataccaggtaaataaggcactgaattgcttaacgttaccacaaaagtataatcgtcaacggcttttacaccgagagaatctacttttttcttcccttcaataacatcttgtgcattttcaatttgcatgtacgtcaaataagaagaataaggagaagccgttttcggatcaacaagacgttgccatgcgaagacaaaatcatgggctgtaacaggcgtgccgtcagaccattttgcatcatgacgtaatttaaatgtccattgcttaaagtccggcgtactttcccacgaagtggcaacaccaggctgaggattaccgtcagaatccaccgtaataagtccttctaaaacctgcaaaacaacctctgcttcaggtactccttctgatttatgagggtcgaaactttgaggttcagctccattattgatgacaatttcttgctttttagccaacacggtaccagccggaacattggctgcaaaagcagatagcgaaaaacctaacgccaccgttgtggcaataagagtgcgggttaatattgtgtgcattgttattctccattgtgattgttgtttgctctgctattaatacatgaaaagattgcttttgtaaataattcatactagttagatagtaagctaattagagtgaattattctagagggcaatgttacatgaattaaattcttaccataataaagtgcggtcatttctctaagtaaagatcgctgagtaaatagccaccttgcggtcttttcccttcataaccttttaatttcggatttttaataaataatccggcgtaatgataaattgcgataaagggatgatgtttgcctaattcttcttcagcttgtgcataaatttccgctcgtttgttttcatcactttcgttgtaagatgcttcaattaattgatcaaacttttcacttttaaagccgattttattttgcgaactattggaaagaaaatatgtcaaaaacgtgcttgcttcgttgtaatccgcagaccatgctgcaaatgccaagtggtaatttttctgattttttgtatctaaaaatgttttccactccatatttttcagcgaaatatcaaccagaccgtctaaatttttcttccacatagaagtaaccgcaatagcaatattttttagtccttcgttagtgttatacagtaattcgcttttcaacggatttgctttactgtaaccggcttcacgtaatagctttttagcttcttcgtttcgttgtgcttgcgtccaattagcatattccggttgggtgattttttctcctgcatgaatatagaacggtgtgaaacggaaagtaggtgtttgtccaaagcctaatactttttctgtaataatgttgcgatcgacggctaaatctaatgctttacgtactttaatattatcaaaaggcggttttgccatattcatttcatacataaaagtacctaatttacgagagctatagatttgcgagtcgtattgagcacgaaatttaggatcatgataaagtgattgaggaatataagccatatccaattcgccggaacgataacgagctccccctgcactttccgttaaaatataaaaagtagctttattaataacagaatgggcgttatcccaataggctggattacgttccaaagtgattttttcatttaacacccgttgtgaaattttataagcaccgtttactacaaaattttccggttttgtccaatcatcaccgtatttttcaacaacagcacggtttaccggataaagagaagtgtgttgagtaagaagaacggcataaggtacgggtgcatcaagggtgagttgtagtgtattatcatctaatgcggtaactcccaaaaattccggtgatttctttccagcaataatatcatctacatttttcattttcatgaagccaaggtaacttgcataaggtgatgcggttttcggatcaacaagacgacgccaagcatagacaaaatcatgtgcggtaagagaatcaccattagaccacttaatatttgggcgtagataaaaagtaacggttttaccgtcagacgaggtatcccagcgataagcgacaccgggaataatattaccgagttcatcggttttcaccaatccttcaaataattgttcagctattaaaccttcccccgatccttctattttttgtggatcaagggtagcaacttcagcagtaatttgaatactgatttcctgtttatccgccaattttgtaccttgaggaacttgtgccgaaaatgcgactgaagaaccgacaagtagaaataagcctaaaagtgcggttctatagtttttatattttaactttgtccatatattgtgttgcataaattttatccttttaagtaagattaaaataataagattttcattagtaaaatatttatgcgatgaagtaaagtatttttacaaattttttgtaatttttaattagcaacctaattactatttttgcattttcaaaaatgtaggagtagaattccgacatcttcaataattcatcataggcggtatttatgcaattgagacgtaaatacatcgcctcgtattgataggagcagtatatgcaatttgcgattatcggattaggtaaattcggaaaatcagttgcacgagagctgtataagctgggtaatcaagttgtgggcatggatattaatgaaaaaaaagtggagcaatgtagccattttcttagtgcaagtttaatccttgatgccacggataaaacagccttgcgagaacttaacattcaagagtttgatgcagtgttggttagtatcggtgaaagtctagaaagcaatttactctgcacacttaatttaattgatctcaaagcaaatcaaatttgggcaaaagctaaaaatgcggcacatcacgctatactttccagtttagggattcaacatatagtaagacccgaaaatgatatgggtattttagtcggtcaatctatgaattgccctagtgtaacccactgtattccgctaggctcggatctctttttaattcatttccttgttcaatttcaaactactattaccctcggtatgctgaaaaaacgctataaagatattgttattaccgctattcaacgaggagaacaacttattagcaatccggatgatgaaactgaaatacatcgtcaagaccatttgctgatcattggctatttaaataatctccgcactttaaccggcgaattaaataaaatccaaaatgaaatttgaacatatcaacacaaagccaccctatgtattagcgggcggttttctctttatcattttaatcggcacattattattggaattaccctttgctcaccataaaagtatttcatggctacatgccttatttacttcaacatcagcggtaacggtaacggggctaagtgtcgaagatacagcaaatttcaccctattcggacaagttgttttaatgtgcttaattcaaatcggcggattgggatttatgacgtttgctatttacatagcaagacgaatgggtgccagaattggcttattcggcaatgcaattgctcaagaagcactgggtgatgtgccttttaatttacttctacatactgccaaaaacgttctaaaatttgcactgacttttgaacttatcgcaatgattattcttactgttcatttttatggtgatgtttctttttttcaagcactgtatcaaagcctgttttacagtatttccgcttttaacaatgccggttttgcactgagttcagaaagtttaatgccttatgtggatgatattattgtcaatatagtcatcactggattgattattattggcggattgggatttgtggtactcatggatatcaaaaatcaacgccaatataaaaaattctcactaaatacgaaggtagtactttgggcaacctgtattttaaatatcgtttcctttctaatattttatattttagaacgacaaaacccgttaacatttggaccgctaagcgaaacaggtaagttgtttgccgcttggtttcaagcgataacaccaagaactgcagggtttaatactgttgatacggcaggattaactgatgccagtagtctgctgactatgttcttaatgtttattggcggaggttccttatccactgcaagcggtataaaaatcggcacattctgtattatagtggtagcgacattcgcctatttacacaaagaatcccatgtcaatttgtttaaacataatttgcctgatgaactaatcaaaaaatcctttgctttattttttaccagccttagttgtattggtattagtagctttttgctcttggcagttgaaccgcaatttcatttccttgatgttttatttgaagttgtttcggctttaggtacagtcggactttcacgaggaattactgctgaactttcaccgttcggagagtcaattttaattatcttaatgtttatcggtcgagtaggattgctcactatgatttatctcattatgcaaccgcactcaagtaaaattaaatatccaaaagaatatatacaaataggctaaaaaataaagggaataatttattcccttattttcctaaatttaatctgttttgcaccgcactttgatcaagtttaacgacaaatatacaaagtaattttcctctaagaatgaaaaaatttatgctaacaaagccaaaaactcattttcgctcagaatgttaataccgagctcagtagctttagttaattttgaccccgcactttcccctgcaataacaaaatccgttttactcgaaacactgccgctaactttacagcctaattgcaacaagtattcttttgcctctgaacgccccattttcgttaacgtaccggttaatacgacggtttttcctttcaaaggattgtcctgcacctctttaacctcaacgtcgtcccaatgaatgccttgtgcaattaaatcttttaccacagcaacattatgaggctcagaccagaatgaacgaatacgtttagccactacttcaccaacatcttgtaccttttgcaattgctcaaacgttgcattttcaaaagcctctagtgtcttaaaatgagttgctaaatttaatgcagtagtttccccaacttcacggatgccaagtgcaaaaataaaacgagccaatgtggtttttttcgctttagctaaacttgctaaggcattttctgccgattttgcccccatacgttctaaacgcattaaagtaacctgatctaatttaaataagtcagccggtgtatgtactaactccctttcaaccaactgttcaattaattttgcaccaatgccgtcaatatccatcgctttgcgtgaaacaaaatgtttaagtgcctctttgcgttgagcagcacaaattaagcctcccgtacaacgagcaactgcctctccctcaattttgctaataacggaatcacacacaggacaatttgttggaaaaataatagattttgcattttccggacgacgttcatgtaacacgccgataatttgcggaatcacatctccggcacgacgcacaatcacggtatcaccaatcgcaatatccaaacgtgctatttcatcaccattatgtaaagtcgcattactcacagtgactcctgcgacaaaaacaggttctaattttgctaccggtgtaatggcaccggttcgcccaacctgaaactccacattattcaaaattgtcagctcttcttgtgccggaaatttataagcaattgcccagcgaggtgctttagaaataaaaccaagttgttgttgcaagtcaatatcattaatttttaataccgtgccatcaatgtcataacctaaggaactgcgtttttgcttaatagtgcggtagaaatccaacactttttcaatcccatgacataattgaatttcattatttaccggtatgccaatagattttagccattgtaaacgagcaaaatgtgtatccggtaattcaactccttctgcaataccaataccataagcgtttaacatcaaaggacgttgaccggtaattttgggatcaagttgacgcaaagaacctgcagccgcattacgtggattagcaaatgttttttctcctttcgctaaagctgttttgttcagtttttcaaaacctgcttgcgacataaaaacttccccacgcacctccaaacgagccggtggattatctgttaataattgcaatggaatattacgaatagtacgaatatttgccgtaatatcttcaccggtcgtcccatcgccacgtgttgcagcctgtaccagctgaccgtttatatacaaaatactgactgccaaaccgtctaatttaggttcgcaacaaaatgtcaaagaacgatgaacatgtattaaacgatcttgaatacgcctaacaaaagcaacaaactcttcatcagaaaaggcattatctaaagataacattgggatttcatgtgttacttgtgcaaaattacttaacggtttcgcccctactctctgtgttggcgaattttcactggcatattcaggatattgttgttccaacgcttttaattgatgaaataagcgatcgtattcactgtccggaatttgcggattgtctaacacatgatactgatattcatgatgacgtaatgtttgtcgtaattcttcaatttgttgcttgatcataaaaattccttgcctcaagaccgcactttaaatagtggctcattatacacaatcacactattctgcgtaaaaaattgcccctgaaaatccagaggcaataaatcaatagaaaagtgcggtctatttttacaaaataatactaccgatcaatgccaaagcaaaaccgactaaaccgattaatgtttccatcacagtccaagtttttaacgtggttttggtatccatttccaagaaacgacttaccaaccaaaagccactatcatttacatgagaaagtacggttgcacctgaagcgatagcaatcacgataaaacataaatcaaattgacttaagcctgtggctgatgacaccattggtgcgatgagagcagaagttgtggtcagagcaacagttgcagaaccttgagctacacgaagtgcggtagaaattaagaatgccgcaacgataattggcatacccgtatccgaaaacatttttgctaatacatcaccgataccgcttgcacgtaatacaccgccgaacataccgcctgcaccggttaccaatacgattgcacaaatcggacctaaggcgttatcgcagattttttcgatttgttcaaaactgcgttgttctttgagtaaaatgatagtcattaataggctaattaataaggcaataggtgttttgccgattaagcgtaaactttgtacccataatgtagaaccatcaattacttttgctactgctaaagtgtttaggaccgtgtctaacataattaaacaaagcggcaacagcaaaataaataatacttttttgaaacttgggggattttgaaccgcagtttcgttaattggagctgcatttaagaaagttttcggtagcggtaaatcgaattttttacctaagtaaagcccatataaataagtagcaaaataccaagtcggtacagctaaaatgaagccgacaatggtgagcaaaccgatatttgcacctaaaatatcaccggaagcgaccggaccgggatgcggaggaagaaatacgtgggtgacagcaaatgcaccggcagcagggaacgcatagcggaataatgaaccaccgaattgttttgcaacactgaaaataatcggcaacattaccactaaacctgcatcaaagaaaatggggaacccgaataggaatgaggcgacacctaaagcgaaaggtgcttttttctcgccgaatttattgattaaggtatcggaaagtacttttgcaccaccggtaatttccaataatcgaccgatcattgcacctaagccgactaataaagctactgaggcaagggtattaccgaaaccgcctaataaggtcggcaggattttatctactgacataccggtagcaagtgcggttaataaactcactaaaactaaggcaacgaaagcatgaaccttaaatttaataatgagaagaagaagtaatgctatggaagcaatcaaaataaagatcaacataaaatttccctattaataaaattaaacagcagcaagcataccaccatcaacgaataacaaatgcccattaacaaaatcagatgctttagatgaaagaaaaacagtcgcaccgattagttcttcaggatttccccaacgggctgctggagtacgtttgcacaaccagtcggaaaattctttgttttctactaacggacgggttaattcagttttgaaataaccgggagcaataccattgacttgaatattatgacgagccaattctacgcacattcctcttgttagcattttcaccgcacctttagatgccgcataaggtgtaatagtgtctcgccctaattcactttgcattgaaccaatattgatgatttttcctgcttgccgtttcaccatatagcgagccactgtttgggaaacaataaatacagatttttggttgacattaatgacatcatcataatctttttccggaaaatcgcagaatgggtggcgacgttgaataccggcattattaattaatacatcaattgctccaatatgttgttcgatatgagcaatggcctgatgaacggcttgagtatttgtcacatcaaaagcaacagcgtgagccttatagtctttagcagttaattcatcagcaaccaattgacatttttcttgattagtaccatttataataacttcagcaccttgttcagcaacaccctctgccaataaacgaccgatgccacgagcagatcctgtaattaaaattcgtttattttgtaaagaaaataaatcacacatcttcttatccttatgcaaagttaagttggatttttgaaatttcatttttattgccagcacgttgaagagcggtttctaattgttcaaatggataaatttcagaaagtaagggaagcggattgattttacctaaacttaaccacttcacggcggtattaaattcctctacaaaacggaaagaacctttccagttaatttcttttgaaatgagaggcatcatattaaattgtggaattgagcctcccatcccaatttgtacgatagtacctttcgcttttgtgacagctaaacaacgttcaatggaggaaatatgacctgaagcctcaaatgaaacatcaaattcgcctttgttttgtaaatattcggaaaaatttccttcagtggcatgtaatacttttgtagcacccatttctaatgctaaatctaaacaacgctgactaatatctgaacagatgatttctgctgcacccaatgcttttactgccgcaacagctaaacaaccgataggaccgacaccggaaataaacacttttttcccctgcaaatcaccgccttgttttgctgcgtgaatagttactgctaaaggctcagcaaataccataacctcatcggaaacttcttgcgaataaggaatacattggttgttatctacaattttatattgagtaaaaccaccatcaacgtgcggattgtacattgcactaccaaaaaaacgcattgtttcacattgattgctatagccacttaaacaatatgcacaacttaagcaaggtttgcttggattaattgcaaccttttgtccttcaaataaattgggagcgttggtctttacaattttaccaattatttcatgacctaaaatcatggggtgtttgattgcaaaattacccactttgccatgttcgtaataatgtaaatctgaaccgcagatactgccacgagtaatttgaattaaggtttgatcttggctttgttcatcaaattcaatttcttgagaaatgacatcaacagattttgctcctttaactacgcaagataacgtgtttattttcataaaatatcctccaatatttctgttactggtaacatatttatttttctagattgggtaaagtttttgtgtttgattttgtgatttacgtcacattttttctttatttttaatgatttttaaaaaaagtgcggttataaaaataaaaatttaaaacaataaatatagatttaagtgttattggtaactttttaaatttttttcaggtacactaagctcaatagcgtgtttattagaggaacaaaaaatgtcaaaaggaaaaagtattattttaatgggggtatctggtacaggtaaaacatcagtaggaactgaagtagcgtaccgcctaggattgaaattaattgatggggatgatttacacccaagagctaacattatcaaaatgagacagggacaaccgctcaatgatgaagatcgtatgccttggttggagcgtattcgtgatgcggcatttagtttggagcaaaaaagtgaaaagggcattattatttgttcagcactgaaaaaacaatatcgagatcaaattcgtgatggaaaccaaaacattaaatttatttatctatccggcagttttgaattagtgctttctcgtctgcaaaaacggcaagggcattatatgaaaactgaaatgttgcgaagtcagtttgctacgttggaagttccccaagctgatgaaactgatatttatcacattgatattgacgcaacttttgaggaagtagtgcagcgttgtgttgaagctatcaagcctcttttagattgatgacaagaaatgcttgggcgtagaggcgttatctaagacgtagattacagacaatatttttgccataaaagatagtttttgagctaatgctacgaaaaaatactcaaaccccaccgcacttggtcagtacagtggggttataaatagaaaaagcgtagtcgatttttaccagtatgcattgttattcctatgttttgttttaaaaataaaattctgcgtggtgtattattgacaaggcgttgtacaaaacaattcaagcgaaattcccacctttgcagtaaaaatttaattctcttggtgttattcttgtacgatctattctctctatatttgcatttttcctaaagcaaaactcgatctatctcacaaaaatattaacaaataatttacaattcaaaccgagcatgctaaaaagcaatcgtttgcaataaaaatattgcatacattgcatacaatacaacatcaatgacatcacacaggagcaactctatgaaaaaaatgaaagtcgtattgaccagtgcaacagttctacttgctacattgcttgccgcttgtggtgataataacaaagcgtcgaaagatgttactgcgagcaacgttgcggcaaacagcagcagtgctgaaagtgaggtaccagccacagtgcaaagcaaatttgtgaccattgctactggcggtgcttccggtccttacaatattattgcgacgacactgacaggtatttatagtaaaaatctaaaaactaattccaaaacacaaactactggtgcatcggtagaaaatttaaacttgatggcacagaaaaaagtggaaatggcgtttgtgatgagtgatgcgttaaatgatgcgttaaatggtaccggcagtttcaaaaataaaattgagaatgtggaacaaatagcagcactttatcctaactatgtacaaattgtcacctctaaacgttccggcattaaaaccattaccgatttaaaagggaaacgggtagcgaccggcgatcaaaattccggagtcgaagtcaatgcacgtaacttacttgccggttttggcatttcctatgcggatattaaggttgattatctcggttatgctgcagcggcagatgctctaaaagcgggaaccattgatgcggcgttcttaaccagtggcttgccaaattctgctttaatggaattgcaacaaagttttgatctgcaattggtctctatcccggctgacggaattaaaaaattagctgcagataaaccgtattttaatgcgatggatattccagcgaacacctatggcaatcctgaaccgattccgacagcggcaattaaaaatgccttggtgatccgtaaagagctcagcgaagcagatgggtatttattaaccaaaaccttctttgaaagtttgccacaattgcaaaccgcacaccaagcggcgaaaggcattaacgtgaaagaagcacaggaaggtgcagttgcaccattacatccgggtgcaaaaaaatattatgacgaagttaatgcgaaataattcgttattaagttggtaagcatgaagataatgcctcgtaacggttggtttgtgctggtgccactcgctgttattgggctttatcctgttcattttatatcagttaccacaaaacaaggcgaatgcatcattggtgatgatcattttgcactacgttggcgtcactccgtcgagcatcaattgtggtatgaacattatcaacgacaaggtgataacctccacctttatcaaacatggttacaaacatttggtgctggaacaccttctcaaggtgaagttgtcacccatgtgccagtgggctatgtcggttttaaacaagatgttgttttacccgaaataaattggattgtttcgcatcgtatggaagggactattttgcttgatgataaacaatttcccgtttatcaaacacttcctaattattctgcggtaacaatcgaaccagctaaatctgtaattgcaacgttgtggttaaggaaatcatgttatgactgattctgtaaaaattgacaccgcacttggtgccaaggaacaagagattttggaaaaatatgaccgtgaatcggtcactcgtcaatccagtagccaatttaataaagggttaattacgctggtttcggttttatattccctttttcatttatacaccaccttttaccccctaccgacgttaatccagcgtgcagtacacgtgggcgttggagcgatattaatcctattaatttatccggcatcgaaaaaacgtcgccaaggttctgttgcatggtatgactggttatgggttattgccggtacgagcggtatgctgtatctcatcaaccaatacaatgacattatgaccgtccgaggtggtattccaaatagcacagatattgtgatggcaatcatcactgtgctagtggtgcttgaggtaacgcgtcgcgttaccggttggattttggtgattttttccttgctcttcttaatctatccattcatcagctcaatggattttatgccggacagcctcctcactcgcccttatgatgttggtgatatttttggtcagctttatttaaaaaccgaggggttatattcctctgctgtgggggcttccgtttcctttattttcttatttattttatttggtgctttcctaagtaaatcgggaatggggcaattatttaatgatttagccttagcgatcgctggtgataaacaagggggaccggcgaaagtagcggtaatttccagtggctttatgggcagtattaacggggcagcggttgccaacgtggtgagtactggagcgtttactattccattaatgaaaaaaatcggttatcacaaaaactttgccggtgcggtagaagccagtgcatccgttggtgggcaaattctcccgccgatcatgggagcaagtgcattcattatggcggaaacgacaggcgtaagctacggaactattgcacttgcagccttacttcctgccttactttactatctcggcgtcattgcacaagtccactttcgtgctggtaaacaaaacctaaaaggcgtccctaaagatcaattgccaagggtaaaagcagtgatgaaagcacgtggtcatatgctattgccaatcttagcccttatcatctttttggcacaatccgtaccagtaggatatgctgcctcttatactattgtgcttaccattttagtcagtcaattgcgtcaagaaacccgtatgggcattaaagatgtaattgaggcattggctgacggggcaaaacagtcgctttccgttatgtcagcttgtgcgacggtaggaattgtgattggcgtgatgaaccttaccagttttggtacagtgattacctcttctatcgttacattaggtgcaggatcgctctttttaaccttatttttaacgatgattgcctccatgatccttggcatgggactaccttctattccagcatatatcattaccgccaccatggcagctccggcattggcaacctttgatgtcccggtattagtggcacatatgttcgtcttttattttggtattttcgctaatatcacaccaccggtcgctcttgctgcttttgctggtgcgggaattgcacaaggtgacccaatgaaaaccggctggcaatccttgcgtctagccctagcgggttttattgtaccgttcatattcgtttataatccgaatatgctgatgattgatgttaccaatgctgcggttattgccaaaactttccctctaccaagtgcattcgaaattattaatgttatcgtatcctctgttattggcgttttgggattatctgctgcggtagaggggtatctgaaaaatactataccaatatggcaacgtattattttagcaatcggttcgcttatgttgattattccggaatggatcacggatattatcggcattgctgttgttgtagtcatagcactacttaatgttcgccaatgtgactaacaattgttctgtgcatacgataaatgacataactaaatgtctaattaacttttttagatttgaaccaatcattaccccttgattttgcatagcttcacaaccggttgtggcggtttgggtgttagaatgtaatgaaaaaggttatttcccttaacacccaaaatactcaaaccccaccgcactttgcaagtacagtggggttttttgttgtgtttcagcaagtttgacaaattaccactgataacctatcgacacggcaccggatactttgccttgggaattgctattaccttgcagtttcagcataaccttaccgttatcgctgatgcgagaataaccaatcgccaacgcactttcgccatcatgtcctgccgccgcaatcgcaaccatggacttgcccggcatagagactgatgccaatgccgccgccgcattcgctccggcaataccggcacgcaatcggcgatcggcatgatgtatttgtgtacgtaacgcattattttgaccatccacgtagtttttattgactgcaacaaatccacttgcatcaggtttgacatccggaattaaaatttccccacggttaccattgatgacgatattaccgttattgcctgataccatcaaccctgcatgggttgccatcaatgacggttcagcggctttgccttgtagcttaatgccatcgagggtgtaacttgctgattgaccggcatgatttcctttgcccataatacgggtaccctgtgccgtcactaccgcttcgctgtctggactgctcactttcaaaccgttgctgttcaacaccgattttttgccattgatttcacgtgtctcaaaagaagtcatgtttttcaactggtcagacaatttaacttctaagcctttgccatctgtttccaccttgatattgccggcagcggtgaggttgctgttaaacgtatcaccttcacctttaattgctaaggtttcgcttaatggcgtacgaacctccataccatcattgccyttraacttcawkccsgatttmgcyaccgcttgcacgtcagcaatggtggctacgttggttaratccgcttggctatcaggtttcactaagtcagcaactttwtcataaccctygtagttggcttcatagtcagcattggcttytgttaattctgtctgagcctyggttaaagcagtttttgctttccctagctcttctttagctttttcaagctgtttcttgttttcctcyaattgagtttgaagtttctttttatcctcaccctcaggcatggcactcatcgccatttctaaaccgctcacrgctaaagttaaatcggttactttttgggctgtagttgaaagttctttcgctttatcgcctattgctttcactttttcctcaacagctttggtgagtkcagtcgctttctcttgagcctcttttgctttrrcykgatcagtttcaggrkcwgsyagtcccaaaccactcgccacgttattcatcccgayaggtgcggtwgtcggctcggcacgaataatcaccttatccgactctggtgtcacatcttgcccatcttgwgcaatgtattttttacttyytrcatcatacttcgcyccctctaaatctttaggatcatagaacttaccatcacgtcctttgacaactttggtatagtcatcgccctcttggatatagaagtcaaacggacgattgctgtctaagtcggatactttttcatccacatagtttttattcgccgcacttgaaccgtcagccgtggcatctaggtctttcaagcccatgattacgcctgtacccgatttaccgtcagtgcctttagcaaacgccagcgtagctcccttgccatcttgaccgtcctcaccgtcagccactttcaagctcacgacatctttaccagccttgtccttaatagcaacctcaccggcttttacctcggttgtgtgcttgccattgcttaaaacattcgcttccgccgtctgatcattgaccaaaacctgatcatcgctgaccacagacattgtcacgccctcagccgttgtcaccaccgctttttccttatcgggatctgtattatccgtgatgatttgcgatgtcgccgtttgtgtatgagcgttacctgcctgatctttcaacacaatttcattgccggtaatgtgagtcgtgttaccgytwtcgccgttaaactcrgcagatttcaarcctgtcaagtcctcagtcgtaccaatcgtcaccaccgcwgtrgtgttcgakgttktgcttggtgtactgcttgctgtgccrgctgttgtcgtacttggagcagaacttgttgaagatgtactgcttgtaccacttcctccatctgtacctgcaccagttgacgaagtcgtgcttggagtgaacgtactatctgcccctacactgctatttgatacagtgtttgtcggtgcggttgtcggagttgtactgcttccgacagttgcacctgtaccttgtgnagccayayytrrcgagccggacgtaccwrcygaagyygyaccatttccacckccrrcggtacttgcaccacttgcgagtgcagaacyamccgcacttggttgtgtagtaccattttgagctaactctactttaatattcaraccrgcattaaacttcaacgtatcgccacgaccgatttgataagttgtaccatcactattcgccacattraayttaaagctatttaatgckkswtcaagrtargacttggtgattaagtccttatcttccacccctttattaccatatgtttgagcttgngataargtmactttrctaaatgtcggtgcgtctttaaacccgatttcgattttggcgttgccgttatcataagtgtattgagtaattaggtttttaccgctgtaannnnnnnnnnnnnnnnnnnnnnnnnnnnnnnnnnnnnnnggcgtacccaaacgcacaatattaatgcttgagccgagatagtgggtgccgttatttgtacctgttggaacatcascrccraacktcaarccmkcgtttaacttcgctcttgtttcgtcaatggcacctttcaatgaggttgggttcttcgctttgaatgaaccgtccacattagacagatattcaaagattggagcagtaaatttcgttttatccttatyaacmkcaayrcctaaytkwyymgctaaatcagcsagttgtttacctgtwacrgcntcttttgaakyytyagcaatttcaccstctgmaakstytttkarttttgmatcattaaarytratttctttyttagytktkyctaamgtgattttcgcmccywtktcatctktaccaccscwratactstytayatctttaagattrttmgccarattatgttgaattgaaccattytyrkctacwwygacttswatrttgtcattttyacctttcttaaagtccaagccatccgttartttkacggtttgcttatttgtgctattagmtttataggttatttttaattcatcmacatakttyttattsacsgcatcrtatttatctgttggatcagcaacataaacaattcttcttctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaatgttatacctttattaacagccgtgattaaatcttcaattgcacctttgaatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatattttttagttgttaatacattgtctttacttgtatcttttacttcttcacttactgttacttctttaaagtttggattttcttttatacctattaatatatttttatttcctttttcataatgtgtcctaatattatcacttaaaaatttatctgttttctttgtttgtttatcttcaactgttatagtcccagcttttattatcaagctatctcctaaatagtgtgttcctttttcttcatcactatctccagctccaaaaataaaaccttcattaattttagcaatattatcatctatcgcttttttaaatgtttttgctgtagctggtgttgaagcagtaatagtttttcctattaattgcttaaattctgattgtttaaatcctttagttgcatctacttctgctcctaatacatttactcctaaattgccaaatacatctattacactatataactgacttccatttattgcatctgttgaagtagcacttatcgttcctggtgctacatgtttaataagacgttgttttcctgtatctcctatacttaaaactgatttattagttccatgtccactaaaactagtaaatttaatactatttgtatctgttgtatattctgaatctgatttttcttktttwgtygcttywgacccttkmcccaacgcaatggartyscyrgcgkcggtttytactgttgcaccttgtccaatcgctactgcaccgacggcgtttgtctctgctttagcactatgaccaataatcaccgcactttttgcacccttgccggcgtttgattttgccccaataagcacactttcttttgcagtttccgctgtcgcaccattaccaatcagaattaattctgtattcgcattctttgtaccgtttgtctcctcattcgtctcatccaatgctttaatattgttccctaacgccacaatatccgtaccgtttttgattttgtttttattaccgatagacgctgtccatgctgcatattcaattaaagtgccatctgctccgtttttacctttcacaaaaaccgcaccgatagcgatagaactttttgattctactaattttgttccgctaccgatcacaacaaccgcaccatttgtctctttaaagctttgcgtaactgtattattagaccctagcacaaatgaattttttacatcaatgctaacatctctacctatcacaaccgcattttctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacacaccgcacttcggctgacgccccgacgctccctcaacacggctcgccacctgacggttattcgctaattcagacacaactttcgtttgacccgttgttacatcgtatttggttttgaagattttgttcatattctttactcgctttaaaaattatctgttaattacttattaagtggttattgatcgaatctattattgtttatttattatctcttactgattatttattaaactttagagagataggttataaacctaaataataggcgatgccttgctttttaagacaaagcagaaaaaggcgaataatactttcgccaaaagattgaggttgaaataggatatttttaagatgttgtttgaacatatccaacctcacaaattcaacttgcaaggttgattttaaagaataaactacgctgtagactgtagactgtagactgtagactgtagactgtagactgtagactgtagactgtagactgtagactgtagactgtagactgtagactgtagactgtagactgtagactgtagactgtagactgtagactgtagactgtagactgtcattttttccgttctatttttttgttaagtaaaagtaaaatttgtcgtattttatcttgtatttatttgtaagaaaagcgtaaattaattattttaatgtcggggcggattatatccgctctttaatgttttgtttaatgtgtttggttttctattcgggttttgacttgcacctcaaataaaattcggagaaaatatcggcttttagtcagtataacaaacgatcatgtcatattctcaacaagtaaataaacgtcgcacttttgcgattatttctcaccccgatgcggggaaaacgacgattacggaaaaagttttactctatggaaacgctattcagaaagccggttcggtaaaaggcaaaggttctcaggcacatgctaaatccgactggatggaaatggaaaaacagcggggaatttctattactacgtcggtgatgcaatttccttatcatgactgcttggtcaacttgcttgatacaccagggcatgaggatttttcggaagatacttaccgcactttaactgcagttgacagttgcttgatggtgattgacagtgcaaaaggggttgaagaacgtacgattaaattaatggacgttactcgtttgcgggacacgccgattttaacgtttatgaataagttggatcgtgatattcgagatccgatggaattgcttgatgaagtggaaagtgtgctgaaaatccgttgtgcccctattacttggcctattggttgtggtaaattgttcaaaggtgtttatcatttgtataaagacgaaacttatttatatcaaagcggtcaagggcatactattcaggatgtgcgtattattaaagggttaaataatgccgacttggatagggaagtgggcgaagatcttgctcggcaattacgtgatgaattggaattggtcaagggggcgtcgaatgaatttgatcatgatttatttattcgtggggaattaacgcctgtttttttcgggacggctttaggcaatttcggtgtggatcattttcttgatggcttgacacaatgggcacccgctccgcaagctcgtcaggcggattgtcgtttagtcgagagtgcggaagaaaaattaacagggtttgtgtttaaaattcaagctaatatggatccgaaacatcgtgatcgggtcgcttttatgcgaattgtttcgggtaaatatgaaaaaggtatgaaactgaaacaggtgcgtttggggaaagaggttgtgctttccgatgcactgacttttatggcgggtgatcgttctcatgcggaagaagcctatgccggcgatattatcggcttacataatcatggcactattcaaattggtgatacctttacgcaaggtgaagatctgaaatttaccggtatccctaattttgcaccggagttatttcgccgtattcgtttgaaagatccgttgaaacagaaacagctgctcaaaggcttggtgcaactttcagaagaaggtgcggttcaggttttccgtccgttaaccaataatgatttaattgtgggggcggttggtgtactccagtttgatgttgtcgtttctcgtttaaaatctgagtataacgttgaggcggtgtatgaaaccgttaatgtggcaacagctcgctgggtagaatgttcagaggcgaaaaaacttgaagagtttaaacgtaaaaatgaacagaatttagcgttagacgggggagatagtcttacttatattgctccaacgatggtaaatcttaatcttactcaggaacgctatcccgatattcagttttttaaaacaagggaacattagtctttgatatgatagacaaaagagcggagatatttccgctcttttttgttgttcaaataggaaagtttgctcggtttaaatgcggtttaaagcgttgtgcctattttcaactcacattaatactcttgaacttcttcgtgttttcctaccgcacttttgatagttaattgcacttcagtagaaataattctatcgagaatatcgctaatgtcatttaatttctccgttatagcgacgccatttttatcaaaatatccgttggatcttaagctaccgataaaagcggaaaagacggctttatcgaaaaattccggtgcattaatgccatgtaatacagataaccgctgtgcaatagattggctttctttctctaaggtcgctttggcaatattcggggtatcttgcaagatactgacggtaatataataacgttgtaaaatttctcgaactcccgccatccataactgtaaaactcttacacgttctttattgattgaaagaagattttctgcacacagaattaatttttgacgtgtaaattcctcaataattttttcaacatattcatctaattcatcttgtgaaaagtgtaaaaataattcctcttttaagaaagggtaaatttttcgagctgcatttgataccaactctttttgtattgcaccatgatgaaaaatgatacttgcaattaaagaaggtaaaacaaaaacatgttggatattattacgataataggtcatcaatactgctgctgaacgttctaaacgcaacatttcaccaaaattatctttttctacgataagtccgactcgttctaagtttaatacatgagtgagcatttcttccggtgtatcagtcggtacaataatatcgttggaataaggggcgtgttgtaaaaagcgttgataacttttcagttgttccaacagttgttcacgagataaagcacgttggcgagaagacaaaagtgcggtgcccgttaagttcattgcattaattgccgctgctttgttgatattgatcatgacttgatttgaaatggcattaactgcagggttaaaccattgagaatgatcttccggctggctatctttccattcaggaaaatgttgatttaagtaattacttaatgtgataggttcggcaaaatttacataaccttgccctaaattgcgtaatttgcggataacacgcaagaccaaaccggcgttttctttctcttttgccgccccccgcaattcttttgcgtaagtatctacctctaatacatgctcatagcctacataaaccggcacaacggaaattggtcggatttggttttgttgtaaggcttgtacagtcatagacatcatacctgttttcggggcaagtaaacgtccggttcttgagcgaccgccttcaataaagaattccacagagtagccacggtgaaataattctgctaaatattcacggaaaatggttgaatataatcgatttcctttaaaggttcggcgaataaagaatgcacctcctcgacggaacatcattcccaccggccaaaaattgaggttaatacctgcggcaatatgtggaggcaccaacccttgatgatatagcacataggacaataacaaataatcaatatgactgcgatgacaaggaatatatacaatttcatgtccttctaacgctaatttacgtacacgttctgcattttggacatcaattccttgatataatttattccataaccagcctaaaaaacgatctgcaacacgcaatccctcgtagttcacattggcggcaatctcatccaatatcttatatgcttctttacgtgctttttctttgctgattctcttacttttcgcttcatctgcgatggcattgagaattgccggtgattgtaataatttattaaacattgcttggcgattaggtaagcgaggacctgtagcggacattctttgtttggcaaaatggatttttgccactcgagcgagttttaaagcaatacttgcatctgttccatattcatcagccatatagcgtaaagaaaccgcttgtgaaaaacgcacaaaagtatcacgcccaaaccaaatagccacagctgttttttggatactatttaataaacgaagttttggtaagccaacctgcttttcatgacccggagaacgtccccaaagtacggaaacaggcactaactgtacatttaaatcaggtaaagagcggtgtaattcaaggtatttttcaactatctgaatagtcgctgacttagcacctttcgatttaaaaaaacgtctaccttcgtctaaaaatacataacgaggtaaacattgcccccccaattcattctcttctaagggatcaggcaatcctacgcttaagcaatttctacggataataattaaatctgtttgtgaagtgtaaggtaataaataaatgatcggttggctaatatctaatgataattcttcgataggttgttgcggtatagggttatttttaactaaaaaagagagagggacggacaaaagattacgataaaaattaagaatacttgacataacaatttccattaacttattaggttgattggctaatgaatactattctaacaaaaaaaatatttttttattaataaattaatttattgaaactaaagattgatgtaattttatttctgtatataatgtcatatattctgtatataaaaacaggggttagtatgagttcaataaaatcattaacgacacgacaacaggaagttttcgatctaataaaacgtcatatcgaaagtacaggaatgcctccaactcgagtggaaatatctaaagaattgggatttcgctctccgaatgcggctgaagaacatttaaaggccttggctcgtaaaggtgtaattgaaattgtatctggtgtatctcgtggtatcaggctattaacggatatagaagaaccggaaaatgaaggacttccgctgattgggcgagttgccgccggtgaaccaattttggcggaacaacatattgaagcaacttatcaagtcgatgctaatatgtttaaaccgcaagctgactttttattgaaggtttatggtcagtctatgaaagatattggtattttagatggtgatttgttggctgttcatagtacaaaagacattagaaatggacaaatcgttgttgctcgaattgaagatgaagtaacagtaaaacgctttgagcgtaaaggttcgattgtttatttacatgcggaaaatgaggaatttgagccaattgtagtagatctaactcagcaaccttactttgaaattgaaggtattgccgttggcattattcgcaataatgcttggatgtaaacatgacatcatgcagtaaatttgttatttaaaaacgagtagcggaacaaaaataagccaacaactatttgttggcttatttttaactatctagcataaatctcagcttcggcaaaaaaataggcaatttcacgttgtgcattctctaaactatccgagccatgaacggaattttgggtttgattaatagcaaattcataacgtaatgtgccattttctgctatttccggattagttgttcccataaaagtgcggtagtcttttaccgcattttctttttgtaacaccaaaacaactataggggcagatgtcatgtatttaaccaattcagtaaaaaacgctttattgcgatgttctgcataaaaaccttccgcctgttcttgatttaaatgcaacatcttcatagcaatgatttgaaatcctttgtcctctaaacgagaaatgatgttacctattaaatttcgttcaactgcatcgggctttataatcgctaaagtttgttctaatgtcataggtctctccattattcagctttatttaataaaaaattcgccaaagtttgtacaccgattcccgttgcacctgttgcccataagtcacttgctgatttacgataagttgccgaacaatcaatatgtaaccaattttcttgataattttctacaaaataagataagaatgccattgccgtacttgcaccggcacccattggaacagtcccaatattggcaatatctgcaaaggatgaactaatttggtgacgatgtaattcgtcaaaaggcaatcgccaaaacggttcttttgtactctttgcacaatcgaaaaactgttgagtgagttcgttatccattgaaagtatcgcatgataatcattaccaaccgctacttttgctgcaccggttaaggttgcgcaatcaagaataaatttaggcttcgctaaatccgcatcaattaagccatcggcaagtaccaaacgcccttcggcatcagtattaagaatttccgcactgataccattgcggtagtgaataatatcacctaattttaaagcgttgtggctcaccatattttcagcacaacataaaaatagtttaactcgtttgttaagccctccggctattgccatacctaatgcacccgttaatagtgcggcaccgcccatatctgttcgcattgtactcatgctatcacttggtttaatgctgtaaccaccactgtcaaaagtaattcctttaccgactaaacaagccagtaccggtgcattttcatttccggtaggattaaaatccagctgtaacatagctggtaaattttctgagcctttacctacttgccaaatcccttgatagtttttttcagcaagttcttgtccggaaataatttgaaaagataccgcactttcgtcagcataaagacttgcttgttcggtgataaattgtgccgcacgctttgcaagttcaataggggtgataattgaagaggggagattaataatttcacgcacaaaatcgccacattgaattcttgccagcaattcagcttgtggctcgtcctctaaatgaggaaattcaatagtataatcttgtttagcggtataaaagccttgatagaatgcccaacaattttctaaatcccattctgatccaataagttcaacttcttttattccttggttgcgtaattttcgagcggctttttgaattaaagaaatgtcttggttacgtgtcggatgatgaatgatggcttgatcgtgagtaaaactgattaaagcttttttcccccattgttcttttgctggtgaaatttctatcttaatttgcatactttatccttaaatttacttgataaaaaaactgatatagatggcactataccagtttttattgaggtaacaagaatgaatagggagaatgatcagaaataaagtctaattagcgtaaaaaagcaggaatgtttttttcatactctgcgattttatcttcatgttgcaaagtcaatcctatattgtccaatccatttaataagcaatgacgacgaaattcatctaattcaaaatgataaattttatttcccgttgtgacggttaaattttctaaatttacatgaatttcacaacctttatttttccatacccattgaaaaatttcttccacttcttcttcattcaaacgaatgggcaacatatgattattcaggctattattatagaaaatatcagcaaaactaggtgcgatcatgaccttaaatccataatccgccaacgcccaaggtgcatgttctcgagatgacccgcaccctaaatttttgcgtgcaagtaaaatcgttgcaccttgatactcgggaaagttcagcacaaatttaggattaggtactgtaccttcctcatcaagataacgccattcgtggaataagtgttttccaaaacccactctggtaatagcttgtaaaaactgttttgggataatcgcatcagtatccacatttgcggcatcaagaggaaccactaaacctgaatgttgtttaataccagccataaatcttccttaatttaattccatataacgaatatcaacaaatttaccgaagacagccgctgccgctgccattgccggacttacaagatgggttcgtccgttacggccttgtcgcccttcaaaattacgattactggtcgaagcacaacgctcccattcaccaagtcgatcatcattcatacccaaacacatagaacaaccgggattacgccattcagcaccagccgcaataaaaattttatctagcccttctttttctgcttgttctttgaccaatcctgagccgggaacaacaagtactcgttttacgttatccgctttttttcgacctttcattactgtagctgccgcacgcaaatcttcaatgcgggaatttgtgcaagatccgataaatacttgatcaacggaaatatcttttaaatcagtttccggagataagccaatataagctaaggctttttctgcggaggctttggtgacgggatcttgcatttctgccggattaggtactttctgatcaataccgataacctgacctggattggttccccatgttacttgtggagcaatgtcttttgcgtctaatatcaccacagtatcaaactctgcaccttcatcggtttttaaggttttccaatattctaccgcactttcccagtcttttccttttggtgcataaggacgatctttcaaataagcgaatgtggtttcatcaggtgcaatcagtccggctttcgctcccatttcaattgccatattgcaaactgtcattcgtccttccattgacaatgcacgaatagcttcaccacaaaattcaacaacatgaccggttccccctgccattgtggttttaccgataatggcaagaataatatctttggcagtaatgccttttgcgacttcgccacgtacttcaattttcatacttttggctctggcttgttttagtgtttgcgttgcaagaacatgttccacttccgatgtaccgataccaaaagctaatgcaccgaaagccccatgagttgccgtatgggaatcaccgcaaacaatcgtcatgcctggtaaggttaatccttgttccggccccataacatgtacaattccttgctgtttactgttcatatcaaacaaagaaattcctgttgctttacaatttttatctagctctaaaacctgaattttcgcttgccctgttaatttgtttacatcacgcacttgagtagaaatactatgatccattgtgccgaaagttttattcacttgacgaacctgacgacctgctacacgtaaaccatcaaaggcttgcggtgaagtgacttcatgaattaaatgacgattaatgtacaaaatcggcacttctcccggtgcttcatgtacaatatgagaatcaaataatttttggtagagtgtttttttcatatttattccgttaagtttttttcactaattaggtaagtgcggtagaaaacgagaaattttggctaaatttaccgcactttatttttcattctctattgcttaaattgcgtttacaattaagtctcccatttcagctgtggaaattggcggatgttcatctgctaaatctgcggttcgataaccttgagaaagaacctgtttcactgcattttctattgaatccgccgcttcatttaaattaaagctataacgtagcatcatggcagcagatagaatttgagcgattgggttggcaatgcctttgcctgcaatatccggagcagaaccacctgccggttcgtaaagcccaaaaccattttcatttagactggcagagggtagcatacccattgagccggtaatcattgccgcctcatcagaaataatatcgccaaaaatattagagcaaagtaagacatcgaaaaattcaggttgcttgatcaattgcattgtcgcattatcaatataaatatgatccaatgttacgtcaggatagttcttggcaacctcattgaccgtttcacgccataataccgagctgattaatacattggctttatcaacagatgttacatgtttacgccgtttcatcgctgtttcaaaagcaactttagctatacgttcaatttcatatttgtaataaacttctgtatcaaaggcacgagtttgcattccctctccatctcgtcctttaggttgaccgaaataaatgccgccggttaattcacgaacagtcatcatatcaaatcctttggcggcaatatccgctcgcaatggacaaaatttttctaaaccttggtaaagtgtggcaggacgtaaattacaaaacaatttgaaatgtttacgcaatggtagtagtgcacctcgttcaggctgctgattagggggtaaatgttcccattgtggtccgcctaccgagccgaataaaattgcatcactttcttcacagccatttaatgtagaagcgggtaaaggcgtaccatgattatcgatggctattcctcccacatcaaaagtgcggtaatttaatttgaaattatattttttttgcactgcatccaatacttttatagcttccgccataatttcaggaccgataccatccccacttaatactgcaatagtataacttttcatgatttttcctctttacatcaactttactgtgaaattttatgcgattttaaatctgccactttattggcacgataaattgcattgattgcatgaattaaggcacgagccgaagattctacaatatccgttgccaatccgacaccatgaaaacgtcgccctttatgttcgacgacaatatccacttgtcctaaggcttctgctccctcaccttttgcagtcaggttataatgcaacatagttatatccatatctgtaattgctaaaatagcgttataaacggcatcaacgggaccatttcccccatttgaaacttggctaatttttttaccgtccagttcaacttgcacaaaggcagaagccggtaaattactgattgtttgagaagtaataacatccaaacttagccgatcttcatcaccctgttgcatatcaataaatgccaatgcttccaaatcataatcaaatacttgcccttttttatcggctaattttaaaaatgcggcgtataatttatccaaatcataatcgttttgttgataacccattgcgtccatatggctttttactgcagcacgtcctgaacgagcggttaaattcaatttttcttttttcaatccgatggtttccggcgacataatttcgtaagtatttttatttttaaccataccgtcttgatgaatacctgaagaatgtgcaaaagcatttgatccgacaatagctttattcggctgaagtggcatattacacaactggctaaccatctgactgacacgatgaatttcttgtgtattaattcgtgtatctaagcccttaaatatatcttgacgtgttttaattgccatgactacttcttccaatgcagtatttcctgcacgctccccaatgccattaatggtacattcaatttgtcttgcaccgttttgtactgcggtcaacgaatttgcagtcgccatgcctaaatcattatggcaatgcaccgaaattactgctttatcgatattcggtactctgttcatcacttgatcgatgatattaccgtattcggttggtaaacaaaaacctaccgtatccggaatattgactgttgttgcacccgctttaattgctgcctcaacgatgcgacaaatgttgtcaacacctgttcgaccggcatcttcgcaggaaaattccacatcatcggtataacgtctggcacgttttactgcttgtattgccatttctacgacatcatcaaaagtgcggcgtaatttagcttcgacatgcaaagcggaagtggcgataaacgtatgaatacggaaagcttcagctacttttaatgcgtcagccgcaatatcaatgtctttatccactgcacgggataaggcacaaacacgactgttttttatatgacgagcaatggtttgaacggattcaaaatcccctgctgacgatactggaaaccccacttccattacatcaacacctaaacgttccaacgccaatgcaatttgtaatttttcttttactgttaaactggcttttaatgcctgttcaccatcacgcaatgttgtatcaaaaataataatgttgttttgcataactctttccttcttattttgtatgttgccatctgcaaagtgcggtgcttttttattgattttagatacaaaaaaacccgcattctacttgtgcgggtcaactgacatgtttaactatacttctttgttccacaatttatccgcacaagaaatgtgatagtcgtaaattgagtaacagagaaagaatgtcaaacataaaatatcctaaaaataaaccaagatgggtttatattacgagtttaaaatgatgtgtcaaatgattttttagtgttttataccaaataaaaggttattcaaaacataagtttaatacataaaactaacttttaataatttaatagtgttaaaatccacatcgttaaaaaattttaattttttctaccgcactttagctctttcatagtaatgaaagtaaatttgtgtttttttgggggttctaaaaaataacttatcggcgttctttgagttgattttgttttaaatcaaataatcctatcatatacaactaaagagttatgcttttaacgtttcattttttacaccatgagtatagcttatgatagaatgcgtctccgaaaatgtttaaataacttcttatgcaaaataatcatctacaactggaacaacttgcctgtcagcgtggcgataagattttgtttactgacttaaatttagatgctaagtcgggagattttgtgcaaattgaaggacataatggcataggaaaaaccagtcttttacgaattattgtgggacttagtttccctgctaaaggtaaagtgcgatggaataagatcgaaattaataaaaatcgtgaagaataccagcacaatttactctatttggggcatcttgctggaattaagcctgaattaagtgcttgggaaaatttacagttctatcaaaaaattggtaattgtcgacaaagcgaggagttactttgggatattctacagaaagtggggttattaggtcgagaagatttacctgcaggtcaactttctgcaggacaacaaaaacgtattgcattagcaagattgtggttatcaaatgcggcattgtggattttagatgagccttttacagctattgataaacaaggtgtcaacgttttaactcagttgtttgaacaacatgtggaaaatggcggtattgtgattttaaccagtcatcaagagattccgagcaataagttgcaaaaagtgcggttagatcaatacaagttttttgatcaagggaatatggcatgatttttgtacaaattatcaaaagagagttaaaaattgcttgtcgaaagcaagctgagatcttaaatcctttatggttttttttgattattttaaccttgtttcctttggttattggtccggatcctaagctattagctaaaatagctcccggaatagcttgggttgccgctttgctatcggcattactttcatttgagcgtttatttcgtgatgattttgtggacggttctcttgagcaattgatgttgacagcgcaacctttagcgatgaccgccttggcaaaagtcattgcacattggcttttaaccggtttaccgttaattttactttcgcccattgccggactattactttcattagagttgcatatttggtgggcattagttttaacattgttgttaggaacgccaaccttgagttgtttgggagccattggtgtggcacttacggtagggttgcgtaaggggggcgttttgctgagtttattagtcttacctctatttataccggtattaattttttctgccgctgttttagatgctgcaacattaaatttatcttataacgggcaactcgcaattctgggagctatttttgtttcagtggcaacactttcacctttcgccatttcaattgcgttaagagtgagcttagaccagtaattaacttagtgaagatttgttttttaaataacatagtaaggacaacatgatgtggaaatggttacatccttatgcaaaatcggaaacacaatatcacttatgtggtaagtttgttcctttgtttgcaacagtatctatacttttattaataaccggcgtaatttgggggcttgcttttgcaccggctgattatcagcaaggtaacagtttccgtattatttatattcatgttcctgcggcaattttttctatgggaatttatgtgtctatggcaattgccggagtgattggtttagtttggcaaattcgccaagcgtatttgagtattctcgctatggcacccatcggtattgtgtttacttttttgacattggtcactggagcaatttggggtaaaccgacttggggaacttggtgggtgtgggatgctcgtttaacttcttccttgattttattctttttatatttaggcgttatcgcactttactctgcttttcaagatcgtttaatcggtatgaaagcagcagcaattctttctattgtgggggtagtcaatattccggttattcatttttctgttcagtggtggaataccttacatcaaggggcaagcattacaaaatttgaaaaaccttccattgcaacacctatgttaattccgcttattctctgtattttcggttttatggcattaacaatgtggtttactttaatgaattatcgaacccaactgttaaaagatgagagcaaacgcccttgggttaaagcattagtaaaataggagtttattatgttttttcaaagttggagtgattttttttatatgggcggttatgggctttatgtttggctatcttatgggatttctttccttgctattataggattaggcttgcaaaatatttatcttcgcaaagccctatttaaagaaattcaacgtgaacaattgcgttcagtgcgtcaaaaaaatacgcaagctgaaaacaatggagaaaacctatgaacccaagacgtaaatcaagattatcggtagtactgtttattttactgggcatatccgttgcctctgctttggtgttgtatgcgttgcgtcaaaatattgatttgttttatacgccaacagaagttgtgaatggaaaaaataacgaaagccataccaagcctagtattgggcaacgtattagaattggcggaatggttgtggaaggaacggtagaacgtgatcctaaaagtttaaaagtcagatttgacttaaatgatattggaccttcagtaacggttatttatgaaggtattttgcctgatttatttcgtgaaggacagggcattgttgctcaaggtgtacttattgagccaactgtactgaatgcaacggaagttttggcaaagcatgatgaaaattatgttccgccggaattagaagcacaaatgcagaaaattcataagcctatgggcatatcggatctcaagaatgaaagtgatcgtgatcgtcaagaaaaacaatttaaagaaggtaaccaatgatcgctgaattaggcaattatgctctggctttaagtttagctatttctgttttattatctatttttccattatggggagcggaaaaaggcaatgtacagatgatggctttagctcgcccaatgacctatggtttatttgttagcttaactgtttcttttgttgcacttttctatttatttctgacaaatgatttttcagtacaatatgtggtgaacaattcaaataccaacttacctttgcaatatcgtctatccgctgtttggggctcccacgaaggttctttattactttggatttggctattgactctttggagtgcggctgtggcttttttgagtaaacaattaccccaagaagctgtggctcgtatcttggcaattatgggtattattacgattggtttcttactatttgtgatgtttacttctaacccttttgaccgcactttccctgattttcctgttgagggaagagaattaaatccattattacaagatattggtctgatttttcatccgcctttactttacatgggctatgtgggtttttccgttgcttttgcttttgctattgcatcattgatgacgggaaaactggataccgcatgggcaagatggtctcgaccttggacaatggctgcttgggtatttctaacattggggattgtgctgggatcgtggtgggcatattacgaacttggctggggcggttggtggttctgggatcctgtagaaaacgcctctttaatgccttggcttgccggtattgcattgcttcattctcttgcggtaacggaaaaacgtggttcatttaaagcatggacagtattgctggcaattttggctttttcactgtgtttattaggtacttttttggttcgttccggtattttggtttcggtgcatgcttttgcctctgacccaactagaggtttatatattttagcttatttaattgtagttattggcggttcgctagcgttatacgcttataaaggcaatcttattcgcacaagaaacaatgctgaacgttattctcgagaaactatgttgttaatcaataatattttattaatgaccgcacttagtgtggtgttcttgggtactctcctgcctttagtacacaaacaattagggttgggaactatttctatcggctctccattttttgatcaaatgtttttattgatcatgattcctttatcacttttattgggtgtcggacctttagtaaagtggcgtcgagaccaattctgtgctattcgtcttccggttatcatcagttcaattattatgcttattaccggatttgttttaccttattttttacaagatcgtattgcagtgagtgccgttcttggtgtcatgatggcaatgtttattcttcttctagcactctatgaattgcagcaaagagcaacgcataagcatagcttttggattggcataacaaaattgtctcgttctcattggggaatggttttagcacatttaggggttgcgatgacgatatggggaattgcttttagccaaaattacagtattgaaagagacgttcgaatgaatgtgggggatacagtaaaaattgcagattatgaatttactttccaaggtatatccgatgtcaatggtgtcaattacttaggcggaaaggcacaaattgacatcagtcgaaacggtaagtttgaaaccacgttgtttgctgaaaaacgtttctatacagtgagtaaaatgacaatgactgaagcggctattgattgggggttatctcgagatctatatgttgcactgggcgaaagtttaaatgatggttcatgggctttacgcttgtattataaaccttttattcgttggatttggctgggaggtatatttatggcattcggcggattactctgtatatttgaccgacgttatcgttttggaaaacttctaaaacaaggataagttatgaataaaaaactttatataccattaattttattcctcggactagcctttgctttttttgtgcaactgcaacgtaatgcacaaagcgataatccaaaagcattggaaagtgccttaataggtaagtcggtgccaaataaactgctaactgatttactgacagataagcaatatgacaatcgtctattcaaacagggtaaacctttgctcgtcaacgtttgggcaacttggtgtccaacttgttatgcggaacatcaatttctcaatgaacttcataaacaaggtattaacattattggcattaattataaagataaaacggataaagccataaaatggatcaaaaagttaggcaacccttatcaagtaattgtaaaagatgaaaaaggatcttttgggctggatctcggtgtttatggtactccggaaacgtttatcgtggatggaaacgggattattcattaccgccataccggtgatataaatgaacgtatctggaaagaaaaaatacagccaatttatcaacaagtaagtgagaaaaaatgatgacaaaattacgttattttctgaccgcactttttctcagtttttcagcacaagctgcgattgatgcacttaattttacctctatgcaacaagaaaaagattatcacagcttgactcaagaactgcgttgtcctcaatgtcaaaataacaacattgctgattccaatgcttcgattgctgtagatatgcgggcaaaagtgtatgaacttttacaaaaaggtcaaaataagcaacaaattatcgattatatggttgaacgatatggaaattttgtgacttataatccgccggtaacaggttcaacaatcattttatgggttgctcctttggctttgatgattcttggtgttgttattgtgctacgccgtaaatccggttcatccagcaaaagtgcggtagaagctcagccaaatttaactcaagaacaacaaaagcgtttagaagaattattaaaagaacgggaataaaaaatgattttttgggtaatttgccttttattaacattagctattgcatttatttgtttttatcctctgcttagaaacaagacagaaaaatcaaccaatttaaaacgagatgaattaaataaggccttttatttcaataggttgaaagaaattgaggaagacgaacaatacggtttattagaaaatagtcaagagtttaaaacagaattacaacaaacgttgttggaagatattcctgaaaaaatggctgttgagaagagcaataagcaatacggacaaatttggtttatttccggttttttgactttagcgattattgctcctttaacttatatgagtgtaggttcttggcaatctgagataatgttagaaaaaacttacgaaaaattaccgcacttttatgcaagagtaaaagaggaagcaaacaaaccgctaaatgaaaatgagctacaacaatttgctgttgcactgcggttaaaattacaaaaagaacccaataatgcggctgattggtggacgctaggacaagtggcaatgaatctggaaaaagcacaacttgcttttgatagtttttctcaagccaataaattagcaccgcagaatattgaatataagctatcacttgctcgaattttgatgttttcacaagatcaaattgatcgtcaaagagggatgaatttattaaaagaagtgttgcgtattgatcatactaatatgcaagccttaagtttgcttgctttccagtattttgagtcggaagattatcaaagagccgctgtaacttggacaatgatgcttcggttcatgccgaaaaatgatccaagagttcctttaattgaaaaaagtattcgtacagcacgtgatgctatcaaagaagatagcaaataaaaccggttatatatgaaaaatttaaagtattttgcacaaaaatatgtggattgggttattcgcttgggaagaattagattttccctattaggtgtttgtattttggcagtagttgctttgcttacacaaatagtggtgagtttaatttttataggaactatctattggcaagatgtagctcgttctattatctttggtttgttttcagctccttttgttttatatttttttacgttattggtagagaaattggaaaaatcacgccttgatttagcgaagttagtggataatttacgcaatgaggtatcagagcgtattcttgctgaaagaaagttatcggttgcgttgagtgagattgaaaaaaccagtcaagataagaccgcacttatgacaacaatcagtcatgaattgcgtacccctttgaatggcattattggcttaagccagattttgcttgatgacaaattaacagagcaacaacgtaattatcttaaaacgattaacgtgagtgctatttctttgacgcatatttttagtgatattattgatctcgaaaaaattgatgccaatcgtatagaattacattatcaaccgactaatttgtgcagctttttaaatgatattaccaattttgctacattaatggcggcacagcgtaaattaaagtttgaattggcgtgcgataaagatttacctgattggctgatgttggatagtgcaagattaagccagatattatggaatttaattaataatgcagtgaaatttacacctgccggaaaaataaaactgaaggtttctcgcttgacggatgatactttttcttttgcgttatctgataccggtgttgggatagcaaaaggggagttggataaaatttttactatgtattatcaagtacaagaaaccgatcataaacctatcggtagtggtatcggtctggctgtgtctaaagcaatagcaggtttaatgggcggtgatttaaccgttgaaagccaattgcatcaaggggcaacctttacgctcactttacaggctaaagctgtagaaaaaccggcagaaagcgaatctaatgtgcctaatacattgacgatcctattagttgaagatattgaggtaaatattattgtagctaaatccgtattggagaaattaggttactgtgtggacgttgccatgaccggtaaagaggctattcaaaaatttgagcaaaattattatgatttggtgttgttggatattcaattgcctgatatgtcaggatttactattgcacaatatttacgtgaaaaatatgaacaaggtgtttatgattttctccctcctttaattgcattgaccgctaatattatgcaaagtaaaaccgaatatcaaaaacaaggcatggatgatgttttacgtaaacctttatctttagaggcgttagtaaattgtttatcggattatttcggtgatgagttaaatacaaagattattaaaaaatcctctttcgtagagttttctgctttatccgatgttcttaatatggaactgttggttgagctgaatgatattttaggtaaagaatttattggtaaaaacctattattatttaagcaaactatgccaagctatgtaaatgaattattagacagttatgaacaatataaacaggatagtgcagtaaaaaaagatttactttctaatgtacataaaatcaagggagcggcggcatccgtcgggttacttcgtttacagcaagttgcctctttggctcaagatgctaaccacgaaaattgggaaacgcatatcgatgagtggatcaataccttggcaaatgattggttggttgatacggcgacattagaggattggttgaatgatctgtaatttattaaggaataatagttgcaaaaaggggagtacaactttaaacttgagcctttgccattgatatagttaacactcgaataattatgacaaatttaactgaaaaactggaagaaactgccagcaataatgagcttttattaggtgagcgttttcgcatggctcgtgaaaaattacagttgtctttagatgatgtatctaaacaaattaatttaagacccgctattttacagcttcttgaaaataatgagtttacacataagagcattcctacaactttcatgaagggttatgtgcgtaattatgcgaagtttctacgcataccggaagaaatatggacaaaagcaatttcctccgtggaggaaaatacacgccataatttaggtaaaaatacttgcttgatgaaagcggtaaatgggcattcttctcatgggcgttggattggttatgtaacggtattggtgttgttgattgtatccggtatgacggcgttatggtggtggggaaattaccaaaaatcaaatcaagaacgtgacacttttgtacaacattatgtagaaaatgtaccatcggagcggattgaaattcaagcggatcaagtgcttgaaaaaaatttaacgatccctgtggaaaagccacaggttgtttctgttaatgaaactactgtcgtaaataaagacagtatggcagaaaataagttgacctcagtttctacgcaagagcaaagtgcggtacaaaatccacaagaaatagtgagcaacaaaacatcagaaactgaaaaaacggttaaaaatacagaaacctttgtcggcggtgatttgcaaatagaaattatcggggccagttgctggattagtgttaaagacgctaaacataaagtattagcacaaaaagaatataaacaaggcgaagttttggtctttactgatggatcaccttattctttaattatcggtgccccaagcaatgttaaaattacttacaaaggtgaacattatccattaaaagttgacggacgtgttgctaaattcaaattacagtaaattattatgtcatcgtttaaaccaactattaatcgtcgtcaatcgacaaaaatttatgtgggaaatgtaccgataggtggtgatgcacctattgccgtacaatctatgaccaatacaagaacgactgacatagaagcaacagtggcacaaattaaagcattggagcgtgtcggtgctgatattgtgcgtatttctgtgcctactatggatgcggcagaggcgttcaaatcaattaaacagcaggttaatattccgttagttgcagacatccactttgattatcgtattgctcttaaggtggcggaatatggggtagattgtttgcgaattaatcccggtaatattgggcgtgaagatcgtatccgtgccgttgttgattgtgcgaaggacaaaaatatccctattcgtataggtgttaatgcaggatctttagaaaaagatctacaggaaaaatatggcgaacctacaccggaggctttgctggaaagtgcgttacgtcatgtggaaattttagatcgtttgaacttcgatcagtttaaggttagtgtgaaagcctcggatgtctttcttgcggtagaaagctatcgcttattggcaaaagcaattaaacaaccactgcatttaggaattaccgaagccggtggagcacgtgccggtgcggtaaaaagtgcggtcggtttggggatgcttttagcggaaggcattggcgatacattacgcgtttctttagcagccgatcctgtcgaagaaatcaaagtcggttttgatattttaaaatctctacgtattcgttctcacggcattaattttattgcctgtccgacttgctctcgtcaggagtttgatgtgattggcaccgtcaatgcacttgagcaacgtttggaagatattgttacaccaatggatgtatccattatcggttgtgtggtgaacggaccaggcgaagcgttaatttcagatcttggagtaacaggcggtaataaaaagagcggttattatttagatggaaaacgtcaaaaagaacgctttgataatgaggatttaattaatcagttagaggcaaaaattcgtgcgaaagtcgcacagcaagatccaaaaaacagaattatctaaaggaagaatattgtggcaaaaacaattcaagcaattcgaggtatgaacgattgttcacctactgaaagtctcttgtggcagtgggtagaagaaaaagtgcggtcggttttacaaacttatggttattctgaagttcgaatgcctatcgtagaaagtacccctttatttgctcgtgctattggtgaagtaacagatgttgtatcaaaggaaatgtacacattttgggataacgatgaacaattaactttacgaccagaaggtactgccggatgcgtgcgtgcggcaattgagcatggctggatttacaataatgaacaacgtctttggtatatgggacctatgtttcgtcatgagcgtccgcaaaaaggacgttatcgtcaattccatcaagccggtgtagaagtgtttggtatagcgaatccagaaattgatgctgaattgattttattaactgctcgtttatggaaacaactgggtatttttgatcatgtaacgttacaacttaattctattggttctcttgagtctcgacaaaattaccgttctgcattagtggaatttttacagcaacatacggatctattaagtgaggaagaaaaagaacgtttagtgaaaaatccactacgtattttagatacgaagaatcaggtgctacaagaagtattaaatgatgcaccgaaattattggattatttagatcaagagagtcgagaacattttagtcaactatgcgatttattagatgccgtcggtattcaatatgaaatcaatcctaaattggttcgaggtttagattactacaataaaacggtgtttgaatgggtaacttccgctttgggggcacagggtacagtttgtggcggcggtcgttatgacggtttagtcgaacaacttggcggtcatgcaacttgtagtgtgggttttgctatgggattggaacgcttggttttactggtgcaagaagtgaataagcaaatcgttttaccaagtgcggtagatatttatgtggtttattttggtgaaaaaacgactttacctgcattccagttagctgaaaaaattcgtacggaattaccgcatttacgcacaatgacacattgtggtggcggtaactttaagaaacaatttaaacgtgcggataaagttggtgcaaaatttgctctagtgattggcgaaaccgaggtgaaaacacagcaggttgtcgtaaaagatttactgggtggtgccgagcaattgagcttggcattaacagatgtagttatttacttaaaacaagcaattactcaataaggatactaaaatggcttatacaatcgaagaagaacaagaactgaatgaattaaagacttggtggaaagaaaattacaaatctattattgtaattgtggttcttgccttttcaggcgtatttggttggcgttattggcaagattaccaaacaacgaaaaaacaaacactttctgcacaatatgatcaactgatcagcagtgccgaaaatcaaagcatctacaatgctcagctggatcggtttgtgcaagaaaatggagaaacaacttatgctgtgtttgccttgttagataaagctaaacttgaagtcagtcaacaaaattttgtgcaagcagaggaaacattaaagcaggctattgtgaatacgagtgatgatattttaatgtcaattaccgcaattcggctagccacagttcaatatcagttacaaaagtttgatgaggctttagcaagtcttaatcaagttaaaggtcaatcttgggatgttagcaagttgttattgtccggtgatatacagttggcaaaaggcaataaagagatagcaaaggacaattttgaacaagcactaacaaaagccacatcttgggaaaaatcattcatccaagtcagattaaatagtctgtaattgtctaattattgaagccttgatacctcaaggcttttttataggaagttatttatcatgaatattcaacacttattgaaaacacaagcctatattaatggagaatttatttctgccaaaaatcaccgcacttttcccgtgataaaccctgctaatcaacaggttatttgtgaaattgcctgttgtggtaaagaggaaacagaattagcgattaaaagtgctaaacaagcacaagtacattggaaaaaatataccgcaaaagagcggtcaaaaattttaaagaaatggtttgaattgattatgcaacatcaagaaagtcttgcatatttactaagtttagaacaaggaaaaccgcttagtgaaagtcgagctgaaattgcttatggtgcaagtttcgtcgaatggtttgctgaggaagctaaacgtgcttatggtgagattatcccacaggtgagagaagatcatcgattgcttgtgattaaacagccggtaggggtagttgctgcaataacaccttggaattttccaaatgcaatgatcacacgaaaagccgctccggcactggctgcagggtgtgccattattattaaacctgcaccggaaacgcctttatccgctttagcattggcagcattagccgagcaagcgggtataccgaaaggtatatttaacgttttaccgacagtatatgcagaagaagtcggaagtgttttaactcgaagtactgatgtacgtaaattaacgtttaccggttcgactaaaattggcaaaattttaatgcagcaatgtgctgatacggtgaaaaaaataagtcttgaattagggggaaatgcaccatctttgatttttaatgacgcagatttagatagaaccgtcgattctgttatagcctcaaaattccgcaactcagggcaaacctgtatttgtactaatcgaatttatgtgcagtcggagatttatcgtgcgtttgctgataaattaaaacaaaaagtgcgatcatttatcgtaggagattttcagcaagaagcggtaaatattggaccgttaattaatgaaagtgcggtacgaaaaattgaacgacacattgaggatgcgttaagcaaaggtgcaattttaactttaggtgggcaacgccattctctagggggaactttttttgaaccaactattttagaaaatgtgtcgcaagatatgttagtttgccatgaagaaactttttcccctctagcagcgttgattcctttcgatacggaagaacaagcaattagcatggcaaatgatagcgagttcggtttagctgcgtatgtgtatacacaagatttcagtcgtatttggcgactttcggaagaattggaatgtggattagttggagttaatgaaggcattatttccaatgaagtctctccgtttggtggagttaagcaatcgggcttgggtagagaaggctctcgtcacggactggatgagtttttagaaatgaagtatttgtgtatgaaagtttagtttgcaatgcaacaagtcaattgattatccctgctgaggtggaaagtacgacaacacgtgtattaggatcggcaattacaagttttgaaactgcgagattagacatcagtaaattccttttagttaaggaaaggggctattgccccttatgataattattgacgcacagtatagtcgcctgaacaaacccatttgtaggtggtaagtgcttccaatcccattgggcctcgagcgtgtaatttttgtgtactaaccgccacttctgcccctaaaccgaattgtccaccatcagtaaatcttgtgcttgcattaacataaactgcggcagcatccacaagggaaacaaattggtgagcaagtcttggtgatgacgttaaaattgcttctgaatgttgtgtgccgtattcggtaatatgtgcaatggcttgttgaatatctttgacaacaacaacatttaaatccaatgaaccccattcttgacgtagctgttgttcttgtacaatagatacttctgcattttgtttttccaatattgaaagtgcggtcggatctgcgtgatattttacatttttgtgtttcaaatgagcgacaagcttaggtaaaaattctgtggcgatactttcttgcactagcagagtttctaaggtgttgcatgtactcggacgttgagttttagcattgtcgattacagccaaggctttatcttgctccgcactttcctccacaaatacatggcaaaccccaacaccgccaataatgaccgggattgtagagttttgtttgcaaaactcatgtaaacccgcaccgccacgaggaataatcatatccacatatttatccaatttaagtaattctaatacgaagtttcgatccggatcggtaatagcttgtaccgcatttttaggtaatccggtttgctccaacgcatcttgaattacttttaccaaaattttattggaataattggtttcttttccgcctcgtaagataacggcattacttgtttttaaacaaagtgttgcaacatcgacggttacatttggacgagcttcataaattacaccaataacacctaaaggcacacgaactcgttctaattttgtaccactttctaaaataccgccatcaatgatttgtccgataggatccgacaatgaaataatatgacgaacatcttttgcgatactatttatgcgttccttggtgagtaagaggcgatcgataattgcatcagataatccattttcttttgccagctgaatatccttagcattttctacaagaattttatcgctttgtaattccaattgttcagcgataatttgtaaggcggtatttttttgttgttgagaaagttgagccaaaatcgtagcggcttgtttagcattttttcccatttcttttaaactcatacaatatccttattttgtttttttaggtaatttatcatgcgttttgactttttctgcttcttgctcttgataatcaaaaataggcaatccccattcgaaataaatggcgagcaaacgaatagtgaagccactaattaacgtaataataatgaccaaattttgattaatctgtaattgttgtaagccaacataaataccggtagctaataatgcaacactggcataaagctctttttggaacactaaaggaatgcggttacagagcgaatctcgtaatacaccaccaaaggctcccgtaacgatagcggctatacaggtaacagtaaaaccatgccccatgtccaaagcaatttgagcaccaataatggaaaatacgatcaatcctagtgcatctaagaccaaaaaaatggtacggaagtagcgtataaagtgtttgataaaaggagctataaaaacagtgagtatagccgctccggtaacaatcaagaaataatgtgggtttttaacccaacccaagggataatgcccgagcaagatatcccgaatcgatcctccaccgatggctgtcattgaagcaataataataaccccaaaaatatccattttttctcgtccggcagccaatgctccggttatcgcttctgctgtaatgccgataatatagagaatactcagtaacataagtgtccttaaagtgcggtaaaaggattactattttagagtgcatagaacaaagaaacaatgttatttttgagctaacccaagaagttaggcggatttactgcaaggaaaatttaaccggataaaaaagaaattctcatatcatcaaatttagcaaggattattcattagaagaataaagtatttctttataatgtttacggcataccgacatataactatcatttccgccaatttgaatttgctcaccgtctttgactgctttaccttgttcatttaagcgtaaaacaaaattagctttacgaccgcagtaacaaatagttttcaattcttcaagttgatctgcccaagccaacagatatttgcttccttcgaataattctgcttggaaatctgtacgcagaccatagcataataccggaatattgagttcatctaccacattgcttagttgatagacttgtgctttcgttaaaaactgagcttcatcaattaaaatacaatgtaatttttgttgcttaatatgcagtgctatttcagtaaaaagatcagtgtctttatgaaataaattcgcttgtctatgaatgccaatacgtgaactcactttacctttaccaaaacgatcgtcgatggcagctgtataaactaacgtattcatgttacgttcacgatagttataatccgattgtaataaggttgtagatttccccgcattcatcgtggaataataaaaatatagttttgccattatgttaatacccaaccgccggaaataatatatattaagtttgatttttccattatttatcttaaattgctttcagttcagtcattgcccagcggggtttaacgtcaatttccaaaggtgaatattcaccttgttttagacgcaaaaaaccgacgtaagcaatcattgcaccgttatctgtacaaaattgaggttgagggtaaaagacctctccttttaattgtttcatcatatccgctaaagattgacgtaattgtttatttgcactcacaccgcctgcaatgactaagcgtttaaagcctgtttcttttaaagctcgacgacatttaattgctaacgtatctactactgcttgttggaatgcgtaggcgatatctgctttagtttgttcagtgagttcaccttcttgtttaattgcttgattaattgtattggcggcaaaagtttttaaacctgaaaaactaaaatctaagccggggcgatctgtcataggacgaggaaagaaaaaacgttcgggattcccttgttctgccaaacgtgaaagtgcactccctccagggtaatccaatcctaataattttgccgttttatcaaatgcttcaccggcagcatcgtcaatactttctcccagtaattcatattgccctacagcattaacacgaacaagctgtgtatgtccgccggatactaataacgctacaaaaggaaattttgggggattattttctaacataggggcaagtaaatgcccttccatatgatgtacaccaatagctttaatgttccaagcataggcaagcgagcgtgcaattgttgaacctactaaaagtgcacccaccaatcccggtccacaagtgtaagctatgccatcaatgtcttttgcttctaatcccgcttgttgtaaagccgcctgaattaatggtgcggttttacggatatgatcacgagacgctaattcagggacaacaccgccataatcagcatgtaaagcaatttgagtatacagttgattggcaatcaatccttttttttcatcgtaaatggcaacgcctgtttcatcacaagatgtttctatgcctagaatacgcattttgtttctcttctttattgaatttcgaaatagagtagattctaccttttttacttaaattaaactagcgtattgatttttttaagagaaaaagtgcggtatttaaaagtgcggtattttttagaatttttttattttttcgacatatctcgcaaaattagcttgcttattttctaaatgaatttttttgtattaacctcttaccagttatgagtacggaacaataggaaaaatatggataaacggaatgagttgttactgcgtttgttacaagtgccgaagttgggagcgtccggaataactcaacttttatcacacatcgatttaaaaacattagaggattatgatgatgttgcgtttcattatttaggctggaaacctgaacaggtaaatagatggttgtatccggatcttagatatattgaacctgcattattttgggcaagcaaaaagggacattatttgatgaatttctatcaagagaattacccttatttattaaagcaaaccataggtgctccccctttgttatttatcaaaggcaatccggaaatacttgctcaacaacaagtcgctattgtaggaagccgtcattgctcacattatggcgagtattgggcaaagtattttgcaacggaattgttccttgccggttttgttattaccagtggactggctttagggatagacggtttttgtcatcaggctgttgtggatattcaaggacaaactatcggggtattagggggaggtttggaagagttgtatcccaaacaacataaaaaattagcacaacaaatgctagattatggcggtgcgttagtgtcagaatttttacctcatcagcctcccaaaccacaacattttcctcaacgtaatcgcattattagcggactttctaaaggtgttttagtggttgaggcaacagaaaaaagcggttcactcattactgcacgttatgctttagaacaaaatagagaagtttttgcacttccggggcaaattcaaaatgagtatagtcaagggtgtcatagattaataaaagacggtgcattgttagtagagaatgttgcagatattgtagaaaatttatcgccttttatgcattatgaacgtcaactaacagcaaaacagatagaaacgcaatttccgccggcttataagttacctgcttcaccgacttatcctgaactctatgcccatattggatatacgccggtagggcttgatgaattatcaaataaaagcggattaagtgtagataccttattgatacagctgttagaacttgaattgcaagatctcgttattgctgaaaaagggttatatcgacggacttaaatgttgatataagcgataactgacttgttttgtgtttttttcttttaataattgccaatttgcaggcgttgttaagcttttttctcgttctgtttccacataaataagtgcattggcatgtaaccaattatgctgtactagtaacttaatggcttgttcagcaagattaaagtagaaaggaggatcaataaaaacaatatcaaagtgcggttcggtttgagttttgtttaaatagtgcaaactattttgattaataacgtttgcattggtacattttaatatagcgacatttttattgagctgattagctattgttttgtctaattcaaggaatgtaacatttttggcttggcgtgaaagtgcttcaaagccgagagaaccgcttccggcaaagcagtctaaacaattggaatcaacgatatgaggcattagccaattgaataaggtttccttaacacgatctcctgttggtcttaaacctgtagaattcaaaacaggtaattttctggcacgccaaagtccggcaataattctgacttcccctttgtttttctcttgtatacggtttggttgattttttttcattaaaaattaattatgataaactaaatgcagtttcgtaattttaacagaaaagtgagcaattttatgtcagaagaaaagaaaaaaggtagattttggtcttggttaggattggggcagaaaacagaagatccgatatcagaacagcaaccggagcaacaatcaggacaacaggaaagtgttgcaagggagcaagaatctacttcgaatatagagcaggttataaaagaaccagagcatattgatgacacttcatcagacttggttttatccgctcatttacaggagcaagaggtaaaagaatactcacttcatgaacgggaactgtctcaaaatactgtaatagaaacagaaagtgcggttgaaaaaacagatatttttattgaagaggatacaacatatcaggctatcaataaggagcagcgagaggaaacaacgattacatcggttaaagaagtaataccgcaagaacaagaaaaaccggctgaaaatggttttttcagtcgtttagtcaaaggattattaaaaaccaagcaaaatatcggtatcggtttccgcagtttgtttttgggcaagaaaattgatgacgagttatttgaggagttagaagaacaactattgatcgctgatatcggtgtgccaactacgacaaaaatcatcaataatttaattcagcatgcaagccgtaaacaattgcaagaggcagatttactttatcaacaacttaaagtggaattagccgatattttaaaaccggtcgagcaacctttacaacttgataacagtaaaaaaccttatgttatcttgatggttggtgtaaatggtgtgggtaaaaccactacaatcggcaaattggctaatcaattccaaaggcaaggcaaatccgttatgttggcggcaggagatacgttccgtgctgcggctgttgagcagcttcaagtttggggagaacgtaaccagattcctgttattgcacaaagtacaggttcagattctgcttctgtcatttttgatgctatgcaatcggcagtggcacgtaatattgatgtgcttattgcggatacggctgggcgtttgcagaataaaaataacctgatggatgagttgaaaaaaattgttcgtgtgataaaaaaatgtgatgaaacagcaccgcatgaaatcatgctaactcttgatagtggaacgggacaaaatgcaattagtcaagcgaaattgttcaatgaagcggtaggattaacgggtattagtctaaccaagttggatggaacagcaaaaggcggtgttatttttgcgattgcagatcaatttaatttacctattcgctatattggtgtcggtgagaaaatcgatgatttacgcccattccaagcagatgaatttattgacgcactttttgtacaagaagagtaaatgttgaaatacaaatcttagaatgatcatcttagatggcaagttattatttagcataaaacgtaggaaattctatactatcgttgactatgcctctaatgataggaagtgcggtattttttatatgaattcaatctagttttaaatcattttacttaacattacctagaaataagatgatgttttcggatgcccaacaatattaacatcacaaaataagttatcacagcgacgaaaatcagccagcccagccaatgtacacgagtgaaaaaggtcatttgtttccaaagactgagtgctggtgaataataccaaataaccgcccccatagtgatcgcagagattaaaactttgacaaaaaagaccgcactttgtcgagtaaaatggtaaatatccgctttagctaatcctcgataaagcaagtaagcattcagtgttgctgacattgctgaagcgatagccaatccaatataactgaacgggatagcgagtaaattaaatcccatattacttaccatagcaataattccaatttttaccggagtttgggtatcttgccgagcataatagccattggctaaaattttaatcagcataaaactcaacaatccggcgttaaatgcccaaagggaataagaggcggcttgcacatcagaaaatgaaaatttcccacgcatgaacagtaccaataacatcggttgtgccaaaacagcaatgccaatcattgccggaatgccaaataataagatcattctgacgccccaatccattgtttgacgaaaatcaaccgcacttttttcaatgttatctgtacgattaacataatgtcgagatagagttggaagaataacggttgaaatcgcaataccaaataaaccgagaggaaattctaataaacgatctgagtaataaagccagctgattgatccagtcattaaaaaactggcaataaaagtatccaatagaagatttatttgatttacagaaacaccgaatagtgccggaatcatcaaggttcttattttttttacgccctcatcatgccaagcccattgaggttttgttaaaaatccggcttgttttaaaaaaggaatttgaaagagaaattgtagcaagccaccaataaagatcccgatagcaagagcaagatcaggactttctaatcgaggagcgagaaaaagagcggtgcaaatcatagctatattgagaagaacgggcgaaaaagacatcacgccaaatttaccgatggtatttaaaattgcaccagataacgccacaaaagtgataaaccataaataagggaaagtaattttgaggagtaaagaggcttgttcaaattttattgcattggggctgtcatttagccaatcaataaaccaacctgtgccaaagatcgccgtaattacaggagaaaaaagcattgctaataaggtcactactgaaaccaatccgcccaaagtacctgatactttacctataaattctctggttttacttaaatcgcctgatttttggtattctgctaaaactggtacaaaggcttgtgaaaaagcaccttcggcaaataaacgtcttaaaaaatttggaatgcgattagcaaataaaaaaacatccgccactacacctgcacctaatatttgtgcagtaataacatcacgaattaaacctaagatacgtgataacaaagtcattgcactgacgataatgcctgatttcaataattttttgctcaaaataagtttcctttcatgaaaaattggcttaattgtatataaattttatttttaagctatattccaaacgaaaaaactgttagaattccgcctacatcgtaactaggctcaacaactaaaggcaattgaggaaagctaacgatggttgtttcggttgtgtctcaccgaaatccttaacccaaattttgctaattgtttattgacaattgtatagaaaaaaggcatattttacgcctttattttttcgtaaactaacagatattttaggagtttgaccttggctaatatcaagtcagctaaaaaacgtgcggttcaatctgaaaaacgccgtcaacataacgcaagccaacgctctatgatgcgtacttttatcaaaaaaacctatgcagcagtagcaacaggtgataaagcagtagctcaagctgcttttgttgaaatgcaaaaagttgtagaccgcatggcatctaaaggcttaattcacgctaacaaagcagctaaccacaaatctaagttagcggcacaaatcaaaaaattagcgtaattttttaaaaccgataaaaacaaaaccgcactttaaagtgcggttttttatcagctgttgattaacgggtactggtactcgttgtcgtacggtttgcacgtttacgctctacctcagttaaaagttttttacgaatacgtacagaaattggcgttacttcaactaactcatcatcatcaataaactctaatgcttgttcaagtgtgagtttcaatggtgtggttaaagtcaacgcatcatctttacctgaagcacgcatattggtgagttttttaccctccagcgggttgacagttaaatcattagaacgactatgaataccaattatttgtccttcataaatttctgcaccatgatcaaccattagcttgccacgatcttgtagggcataaagtgaataagccaaggctttacctgtaccgtttgaaatcagtacgccgttaatacgctggccaatttcacccggttttacatcatcataatggctgaaactagagtaaagtaagcctgtccctgaagtcattgtcataaattcattacggaaaccaatgagcccacgacttggaataatgtattctaagcgagtacgacctttaccgtccggtatcatatcacgtacttcacctttgcgaataccgagtgcttccatgacagaaccttgatgttgttcttcaatatcaatagtcacttgctcgaaaggctcttgcttgcgaccatcaatttctttaaaaattactttaggacgagaaaccgccagctcatagccttcacgacgcatattttcaattaatacggataagtgcaattccccacggccggatacactgaaaatatccgaatcatccgtttcttctacacgcaatgccacattatgtacaagctcttttttcaaacgctctaaaatttggcgggaagtgacaaatttaccttcttttccacagaatggtgaagtatttacacaaaagaacatagttactgtcggttcatcaacgcttaatgcaggcaatgcttccacattgttaatatcacaaacagtatctgaaatatttaactcacctaaaccggtaatggctataatatcacctgcataagcttcttgagcttcgtaacgctgtaaacctaagtgtcctaaaacctgaccgatacgaccattgcgggttttcccttcaggatcaattaatgtaacaggttgatttggttttactgtaccacgtttaatacgtccaatcccaatgacacctaaatatttgctgtaatctaattgggagatttgcatttggaacggtgcatccaactcaacatccggcggcgaaacatgttcaataattgcttcaaagagcggatccatattagaagccaatttttcatgttcaagaccggctacaccgtttaacgcagaagcataaataataggaaaatcaagttgttcatctgtggcacccaaatttacaaagagatcaaatacttgatctactacccagtcaggacgtgctccgggacgatccactttattgatgacaacaatcggttttaaaccatgtgagaaggctttttgggtgacgaagcgggtttgtggcattggaccgtcaaaggcatcgacaaccaacaatacggaatctaccattgaaagtactcgctctacttctccaccaaagtctgcgtgtcctggtgtatccacgatattaatacgatagccgttccaattaattgcggtatttttcgcaagaatagtaattccacgttctttttccaagtcattggaatccattacacgttcatcagtatcaccacgagaagtgtctaatgtgcctgaaagtttaagaagcttgtcaacgagggttgttttaccatggtcaacgtgtgcaataattgcaatattgcgtaatttttgaatatcaattttatctgtcatttgaataatctagagttataaaaaattaaaaatttcttccgcactttacgtttcaaaatagttcatttttacatctataccgtgcggaaaggtcgccgattatacaactttttgttattaggagctataaaaaaacgacctccgaccttcaccgatataaaattccctatcctattcccctctaattgattataatctccgttcaaatttatttccgttcccactaaagtagagagagtattatgtcaaacacaacagctattacgaatgtattcaagttaatcgaagaaaatgatattaagtttgttcttcttcgttttaccgacgttaagggtaaagaacatggcgtttccctgccggtcagtttagttgatgaggacttgtttgaagacggtaaaatgtttgatggctcctcagttgaaggttggaaagccataaataaggcagatatgttattgatgccaattgctgaaaccgccgttgttgatccttttgctcaaattccgacactttcaatccgttgcagtatttttgaaccgactactatgcaaagttatgacagagatccacgctcaattgccatgcgtgcagaaaattatatgcgttcaacaggcgttgcggatgatgtattttttggtcctgaaccagagtttttcttatttgatgatgtgcgttttgatgtctcgatgaacggtaactcttatactgtcgacgatattgaggcagcatggaatacaaataaacactatgaaggtggaaataaagcctatcgtcctttgaagaaagggggatattgtgcagttgcaccgaatgatatcgcacatgatattcgctcggaaatgtgtttgttaatggaagaaatgggattagtgattgaagcccatcaccacgaagttgcaacagcggggcaaaatgaaattgccactaaatttaatacacttacgttaaaagcagacgaaacgcaaatttataaatatattgtgcaaaatgttgcgtatgaacatggcaagacagcttgctttatgccaaagccaattataaacgacaacggttcaggtatgcattgcaacatgtctttgagtaaggacgggaaaaatattttccaaggtgataaatatgcagggctttctgagaccgcactttatttcattggggggattattaagcatgcaaaagccttaaatgcgtttaccaacccatcaaccaactcttataaacgcttagttccgggatttgaagcacctgttttattggcttattcagcaagtaaccgctctgcatcaattcgtattccggcggttactaatcctaaggctattcgtattgaagcacgtttccccgatccgttggctaacccatacttagcgttttcagcattattaatggctggtttagacggtattcaaaacaaactttatcccggtgatgcaatggacaaaaacctctatgatttaccgccggaagaactgaaagacattcctgccgttgcaagttcattaagtgaagcgttagataatttagaaaaagattatgaattcttaacgcatggtaaagtattcagcaaagaatttattgatacgtttattgcaatgaaacgtaaagaagtggaacgtttaaatatgacaccacatccagtagaatttgaaatgtactacgcttaatactggttagataaacaaaaagcgactaaatttgtttgagctgacctcacaggctagacagatttaatgcaaggactgtgttatatcatttacaggtcgcagtccttttagtttcacgtgaatatattcaaattgttgtaataaagtatctgaaattttcccgactttactctgataagaggatactttcttcgctggcaattcttaattttataccgcactttttactctttttttctcagcgaaacttctcctccgttaaattttctcaatactccattattcaacgctactaatagataaccctcttcatcaataccttgctcaattccacaaacgatttctttttcgctaataatatttacttcttgtccaaaaaaataatccaacttaatccaacgctgaaaaaaagcatgcattccctgttgctcaaaaatagtcaaatattgataccatttttttactaattgaattgcaagatcattacgatctatttccggcaaagtttccaataattccgcccaaggttgatcaattttgttttcttgcggtaaagataaatttatcccaatgccaacgataaaattaagtaatccatttttagcattgacgatttcaactaaaattcctgctaatttccgtccgaacaatagcagatcattcggccattttaacttaacctccgcacccatttcatttagcacttcagcagttgccagtcctaatactgaacttaaaccgtttaacgaaactgtcggattgaatgtccaataaaaactcaccattagttgaccggcaaaaggcgattgccattcccgtcctcgtctacctcgccctgcaaattgatactcggtaaaacacaagtctcctttgttcaactgtaaaatgttttccatgagatactgattagttgaattgataatagggtgataataaatcttataaggacttaattctgtttccaaataagatagatttaataaaggaagttgcggttttaaagaaatattttgctcattatcaacaatacaaattccttgttgtcttaattgtgctatctgcttttccagttgtactcttgtcaggtctaaaagtgcggtcaaattttcataagaataaggtttgcatctagctagaatagacaataatttaaacattttttcctcgctatcaccattataaaatctctgttagcagtatttttaacacaatctttttcaagagaaaatattataaaaaagcattttcaaacaagtatgagatctgtataatcccgacgcaatattttttatcctttttaatcttaatagagagaatattgcactatgttacgcatcaaacaagaagctttaacttttgacgacgttctattagttccggctcattctacagtacttccaaatactgccaacctttcaactaaccttaccaaagaaatccgtctaaatattcccatgttatccgccgcaatggataccgttaccgaggctaaattggctatttctttagctcaagagggcggtatcggatttattcataaaaatatgaccattgaacgtcaagcggatcgtgtgcgtaaagtaaaaaaattcgaaagtggaattgtatctgaaccggttaccgtttcgccaacaatgacgttaactgaattagcggaattggctaagaaaaacgggtttgcaggttatcctgtagttgatgaacaaaaagggttggtagggatcattacagggcgtgatacacgtttcgtttcagacttgaataaaactgttgcggattttatgaccccaaaagatcgtttagttactgtgaaagaaggggctactcgagaagaaattttccatttaatgcacgaacatcgtgttgaaaaagtgctggtagtggataacagctttaaactaaaaggcatgatcaccttaaaagactaccaaaaagccgaaagtaagccgaatgcgtgtaaagatgaatttggtcgtttacgtgtcggtgccgcagtcggtgccggtcccggtaatgaagaacggattgatgcgttagtgaaagcaggagtagatgttttgttaatcgactcatctcacggacattccgaaggcgtgttgcaacgggtacgtgaaactcgtgctaaatatccaaatttacctattattgcagggaatattgcaacagcggaaggtgcgattgcattagctgatgcaggggcaagtgcggttaaagttgggattggaccgggatcaatttgtacgactcgtattgtaacaggtgtgggagtgccacaaattacggcgattgctgatgctgctgaagcattgcgtgagcgtggtattccagtgattgccgatggtggtatccgctattcgggtgacatcgctaaagcgattgcagcaggtgcatcttgtgttatggtcggatcaatgtttgcaggaacggaagaagcaccgggtgaaatcgaactttatcaagggcgagcatttaaatcttaccgaggtatgggttcccttggtgcaatgtcaaaaggatcttccgatcgttattttcaatccgataatgctgcggataagctagtgcctgaagggattgaagggcgtattccatacaaaggcttattaaaagaaattatccaccaacaaatgggtggattacgttcttgcatgggcttaaccggctgtgcgactatcgaagaattacgcactaaagcccaatttgtacgtatcagcggagcaggcatcaaagagagtcacgttcacgatgtgaccattaccaaagaagcaccgaattatcgaatgggctgatataacaaacggttggtttttgcaaaatttgcagaatttgtgtcgcttgtactgagataaggagcataaaatgaaaaaattaggtttgatttctatactgttattgtccggctgtggcatttttggtccatcatattcagggcaaacaacagcagactggttattaaaatcagatacagaaagcactattaggctatattttcgtgctataaataattgtggaatagaaaaaatccatacggaaatcaattcaataccgagtgcaggtaatgtaaatgaaacttggactgtaacaggctgtaatataacaaacgtttttaatgtgaaatatgttagtgacggtcatggcgggacttactttcgcgtatctaaaaaataaactaaaactttaggaaacaaaatgacaaatatccatcaccataaaatcctcattttagatttcggttcacaatatacgcaacttatcgcacgtcgtgtacgtgaaatcggggtgtattgcgagctttgggcttgggacgttacggaagaacaaattcgtgagtttaacccaacaggaattattctttcaggcggaccggaaagtacgactgaagcgaatagtccacgtgcaactgaatacgttttcaatgcaggtgtacctgttttaggtatttgctacggcatgcaaaccatggcaatgcagttgggcggtttaacagaaacttctacgcatcgtgagtttggctatgctgaagtttctctacaaaatccgaccgcactttttgcagatttaaacgatgatctgaccgcttgcgatccaaaattggacgtttggatgagccacggcgataaagtgactcgcctacctgataatttccaaattacaggcatgacctcgacttgcccgatcgcggctatgtcagatgaaagccgtcgtttctatggcgtgcaattccaccccgaagttacccacacaaagtgcggtcaaaaattactgcaaaattttgtggtagatatttgcggttgcgaaaccaattggaccgcagaaaatatcatcgaagatgcagtggctcgcattaaagcacaagtgggcgatgatgaagtaattttaggcttgtcaggtggcgtggattcatctgttaccgcacttttattgcatcgtgccatcggtaaaaatttacattgtgtctttgtcgataacggcttactccgtctaaatgaaggcgatcaggtcatggaaatgttcggtgataaattcggcttgaatattattcgagtagaagcagaagatcgctttttagaagcattaaaaggaattgatgaaccggaagcaaaacgcaaaactatcggtaaagtattcgttgatgtattcgatgatgaagcaaaaaaattaactgacgtaaaatggttagctcaaggaacgatttaccctgatgttatcgaatcggcagcaagcaaaaccggaaaagcccacgttatcaaatctcaccacaatgtaggaggcttacccgattatatgaaattaggtttagttgagccattacgtgaactcttcaaagatgaagtgcgtaaaatcggcttggcacttggcttgcctgcagaaatgcttaatcgccacccattcccaggccctggattaggtgtacgtgtactgggtgaaatcaaaaaagaatattgcgatttactgcgtaaagccgatgcaatttttatcgaagaactgcataaagcagattggtactacaaagtcagccaagcgttcagtgtcttcttgccggtaaaatctgttggggtaatgggcgacggtcgtaaatatgattgggttattagcctaagagcggtcgaaaccattgactttatgaccgcacattgggcaaacctaccttatgatttattaggcaaaatctcaaatcgcattatcaacgaagtcaacggcatctcccgtgtagtttatgacatctcaggaaaaccaccagcaacgattgagtgggagtagctaaaaatctaaagccttataaatagacattttgtgagtgttgtgcttgcaataaatcacctgaaggataattcttcgggtgattatactattaattcagggactgtattagattagccctaaatgacacacattttcgtagtgtttttaactgctctttagatattccaaagacttacattccttcaaaaataaaggagagtttattcggtcaattccattgtattttcagagtattcgtttggcttagcccccaaattttctatgtcgttgatgtagtcttgtttgactgcccccgaaatgattaattctttcgtggtgaaattcacttacatcaagggctaaatgataacggattagctcatggatgtttcgataaaacaatgcacttgaattttgatttatacctaaaatatctgctgcggatcgtgctgttacttctagcacaaaaaattcaaggagctttttctgtatagatttctttaatttacaatgagttgtcttcatttttatagactagcatacttgctaatctaatattgcccctttttttatattgatgagtttgatagatagacactatcctaaaaaatcacaaaggcagcttaattctacaggtgataagattggaaatcggaagcttggtagagaagcaatttaaaagatatatcaatatcataattgcccgaattttcgctaaaaacgtaatatcgggcaaattatatggcattgtaaagagaataaatgtgaagcagttcacattctatacacaaattattgctgtatgatgaaataatttgttttattttatatgagaattgaaaatatatttcaaacttgtttcgtaatatataaagaggagtttgttatatgaatagtaaatttaccccccccctctccatttccacgcctgttgggaatctattaaacagcatcaagttcctgaatggtatgaagatgctaaattcgggatttttattcactggggaatttattccgtccccgcgtttgcaccaccgacttgtcaattaggtgagatcgatattgacgagcaatggttctgtaacaatccatatgccgagtggtatttcaattcaattaacgtcaaaaaaggtccgacttacgagcatcatatcaaaacctatggtgaagatttcagctatgaacagtttattccacaatggaaagcggagaagtggcaacctgccgaatgggcggagctgtttgccaaagcaggtgcaaaatatgtggtgctgaccaccaaacatcatgacggtttctgcttatatccaagtaaatataccgatttcaactgcactgaagctggtccacaacgtgatttgatgggcgagctgactgataatgtgcgtgaaaaagggctgaaaatgggagcttactactctggtattatagactggacctactcttctgcaccgattttcaccgagagtcaaaacttttccaatgcttgcccaacctatgaatacgccgattacgcttataaacaagtggttgagctgattgataaatataaacctgatgtactttggaatgacatcggctggccgaaagccggtgaacatatgcttccgcacttgtttgctcactactataacagcgtgccacacggtgtggttgatgaccgttggaacaagctctggtgcgatttcacctcaaaagagtacaaacacggcgtggcttcgcgtgataaaaaatgggaaatgtgccgtggtatgggcttatcatttggttacaacaaagtggaagatgaaagccacttgatttcagtgaaagatctgatttcgctcttagtagaaaccgtggcagacaacggtaacctgttgctcaacatcggcccaaaagcagacggtactattccacaagagcaagttgaacgcctactctccttgggtaaatggttggagcaaaacggtgaagggatttatcgctcccgttgcagtaaatattcccccgaaactgtaaacggtgtaacaatgattgcccaccctcagaacgaccaaaatcgcacgtcttaatcgttccgagtgctgtatcgttacaacaaacagcggctgtttaaggaatccatcagcagcgtgggcgtgttaaaaactgtttgcattccttaaaaaaatacatataataataattcttatttgcatattttatataatataagaaaggatataggtaaatgacctctttcaaattattaggcttttcggtcttgagtgtggctgtgctctctgcctgctcttccggcaaaggtagctttgatttagacgacacccgccatacccccccctcctcatcgggtagttcccgccccactcatcaagacgttccgactggacaacggcagcaagaacaagtagaagaaatcaaccaacccgccctaggttatgccacaaaaattccgcgtaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctacaaaattgatgctgatatcaaaggcaatcgctttgtcggttcggcaacggcaaatgaaaagactcacaccattttcggcaaggatgctaaaaaccgtctcgagggcggtttctttggtcccaaagccgaggaactggcaggtaaattcttgacggatgataattccctgtttgttgtctttggtgcaaaacgtgaaannnnnnnnnnnnnnnnnnnnnnnnnnnnnnnnnnnnnnnnnnnnnnnnnnnnnnnnnnnnnnnnnnnnnnnnnnnnnncgatggacacgttcggcaatgcggcctatttagtgttggacggcagacacttccccttgttgccggaaagtaatgccggtacgacgggcgctagcaacacaggcaagaatgatttcatctctaccatagatggtaacagtctaaagacgaaaaaccatgagaatcacaaaaaatacaaagttaccgtatgttgcagtaatttggtgtatgtgaaattcggcagctatggggaacaaacaacagcaaacggtgcttcaaacagcactgccggtacatcaactacgcataacagcacattaacaaacgggcaccttttcctaaccggtgaacgtacttcgcttactgatatggcgaagcaaagtggtgcagcaaagtatattggcacatggcaagccaactttttaagtagcaaaggacaggttggcagtgttgacgccggtgatccgcgtaataatagtggtaaaagccgtgctgaatttgatgttgactttggcggtaagacagttgcaggcaagttttttgatgccgacggtactcaacccgccctcacaatggaaaaagccacgattacagataacggattctccggcacggctaaaacaactggtggtttsncgctagacaaaggcagtacaggtgcgggtaccaaagtaatcttcaccgatgctaaagtcgagggcgcattctacggtccgaacgctgaagaaatcggcggtaccatcacatcgaacggcacgggcgacaaagtcggcggggtgttcggcgcgaaacgccaagaactatcgaaatagaaatgaaatcttaactctagctacctgaaacacaagtcaggtagcgggatgggtatctgctgatatggtcaacctgcttgaaaaagtttgtcaaatccgtcgcctgtcgttgttgacggtgtgatgttgcagtggcaaatcgctcggctctgttgagaaagcatgacccatccgtcttttactcacacggaatgaaaaaaatgtctacaaaacctttgtttaaacttaagccaataacattggctgtcagcacgatttttttaccttttactgaggcggttgccgatactgaatcaccgagtagcaatacagaagcagtgctggagttagaagctatccaggtgcaagccaaacacgagatcagcagacatgacaatgaagtcactggtttgggtaaggtggtcaaaagcagtgaagacattgataaagaactgattttgaatattcgcgatttgacccgttatgatcccggtatttcggtggtggagcagggacgtggtgcaacgtcaggctatgcaatgcgtggtgttgacagaaaccgcgtggctatgttggtggacggcttgggacaggcacagtcgtattctaccttgaaatccgatgccaatggcggggcgattaatgaaattgaatatgagaatattaagtcaattgaattgagcaagggatccagttcggcagaatacggtagcggtgccttgggcggtgctgtagggtttcgtaccaaagaagctgatgatgtgattaaagaggggcaaaactggggcttgaacagtaaaacggcttacagcagcaaaaacagccagtttacccaatccgttgccggtgcgttccgtgtcggcggttttgacagtttggcgatttttacccatcgtaaaggtaaggaaacccgcgtgcatcctgccgccgaagaaatacaacatacttaccaaccattggaagggtattttaatcggtatgatgttgaccaaagaaacggaacgcctgttcgggcgaatgcgtattatatacttgccgatgaatgctctaatctaagtgatccgaattgtcgtcatgctaaggccaagacgaatttgtcgggkgtgctggagaacaatcctaattggacgtccgaagagcaggcgcaggctgctaaaatgccgtatccgacacgtaccgcctctgccaaagattatacgggtcctgaccgcatcagccctaatccgatggactaccaaagtcgctctttcttctggaaaggtggttaccgcttgtcgcctaaccattatgtcggcggggtgttggagcatacgaagcagcgttacgatatccgtgatatgacgcaacgggcgtattacacgaaagaggatatctgccgcagcggatccagttgccaaacgttggataaaaacgatacggacaaaggtaatttcggtatcacgttgactgataatcctttggacggtttggtatatgatgccggcaatcaagcgcgtggcgtgcggtacggacggggtaagttttttgatgaacgccatacgaaaaatcgctcgggtattttttaccgctatgagaatcccgataaaaattcttgggcagatagcttgaccttgagtattgaccgccaagatctcaaactatcgagccgtatccattggacgtattgcaccgattatcctcatgtggcacgttgccgtgccagcttggacaaaccttggtctaattaccgtaccgagaaaaacgattatcaagaacgactcaatttgggacaattcaattgggaaaaaacttttaatctgggctttaccacgcataaggtgaatatcgccgccggctttggtacacatcgctccaccttacaacatggcgacttatatgctgaatatgtcaccttgccaccgtatgaggaaataaaagtgtatgatgataaaggtgcctttaaaacagatccgacaccagaggagaaattacaatacggcaatggttcttataacaaacctcgcgtatatagacgtaaaaacacgccggaattaaaaactgtcaatgggtgcaatgagacagcaggtgacaatcgcgactgcacgccacgtgtgattacgggcagacagtattaccttgccttgcgtaaccatattgcctttggtgaatgggcagacttggggttgggcgtgcggtacgacaaccatactttccgctcgactgacccgtggaccaaaggtggcaactaccacaactggtcgtggaatgcgggcgtgagcctcaaaccgacccgccactttgtcgtgtcttaccgtgtgtccagcggtttccgtgtccccgctttttatgagctgtacggcgtgcgtacgggggcttctggtaaagacaatccactcacacaaaaagagttcttgagccgtaaaccgttgaaaagcgaaaaagcctttaaccaagaaattggtttggccgttcagggagattttggtgtgatagagaccagtttcttccaaaacaattataaaaatctgcttgcccgtgcagataaacatgtcgagggattgggttatgtaaccgatttttacaacacccaagatgtcaaactcaacggtatcaatatcttgggtagaatctactgggcaggcatcagcgataggctgcctgaaggcttgtattccacacttgcttacaaccgtatcaatatcaaagcacgcaaattgcacgacaattttaccaatgtgtctgagccgacattggaagccgtgcaaccgggacgcattattgcaagtatcggctatgatgaccctgagggcagatggggccttaatttaagcggcacctactctcaagccaaacaacgtgacgaagtggtcggcgaaaaagtgttcggcaagggtggcagcattaaacggacgatcaacagcaaacgcactcgtgcttggtatatttatgatttgacggcatactacacttggaaagaaaaattcacgttgagagctggtatctataatttaaccaatcgtaaatatagcacatgggaaagtgtgcgtcagtcctctgccaatgcggtcaatcaagacctaggtacacgttcggcacgttttgccgcaccgggcagaaactttaccgtgagtatggaaatgaagttttaattaaaaaactgtctgcaagctgtttaaaaaacagttaagatgatttgttcgtataaatagcagcttgaagtcttgttatgcaggttcaggcagcttgacattccaaaaaaaggaaaaaagtctaatggaagacaataggctatttgtcggcaacgaaattaggcaacgaaaaattgttgcaatggattagcagttcaagtggcttccggtattttttatcgcactttttctatctataagcttgaaatctttatttccgaacttatattttcgctgtttgttaatttcactattggaaaaggaaatattatgtcaacaaatcaagaaacacgtggttttcagtctgaagttaaacagcttttacaattgatgattcattctctttattcaaataaagagatttttttgcgtgagttgatttccaatgcgtctgatgcggcggataaattgcgttttaaagccttgtctgcacctgaattatatgaaggagatggtgatttaaaagtgcggatcagttttgacgcagagaaaggtacgttaaccattagcgataatggtattggtatgacgagagagcaggtgatagatcatttaggcactatcgctaagtccggaacaaaagaatttttggccgcacttggacaggaacaggctaaagataatcagttgatcggacaattcggtgtcggtttttattcggcatttattgtggcagataaagtaacagtgaaaacgagagcagcaggtgagccgatagataaagcggtgttgtgggaatcagccggtgagggtgaatattctgttgctgatatcgagaaaaaagaacgtggtacggaaattactttgcacttacgtgaagaggaaaaagagtttgctaatgaatggcgtgtacgtgaaattatcggtaaatattctgatcatattggcttgcctgttgaaattttagcgaaagaatatgatgaagaaggtaaagaaacgggaattaaatgggaaaaaattaataaagctcaagcactttggacaagatcgaaaggtgagatttccgatgaggaatataaagagttttataaacatttaagccatgattttgctgatcctcttttatggacacataataaagttgaaggaaatcaagaatataccagcttgctgtatgtgccgtctaaagccccttgggatttattcaatcgtgagcataaacatggtttgaaactttatgtacagcgtgtatttattatggatgatgctgaacaatttatgccgaattatttacgctttatgcgtggcttaattgatagcaatgatttgccgctaaatgtatctcgtgagattttacaagataataaagtgacagctgctttacgtaaagcattgaccaaacgctcattgcaaatgctggaaaaattagccaaagatgacgaggagaaatatttacaattctggaaagaatttggtttggttttgaaagaaggtccatcagaagactttgcgaataaagaaaatattgccaaattattgcgtttcgcttccagtaaaaatgatagctcagaacaaaccgtttctttggaagattatgtcgctcgtatgaaagaggggcaaaaggcaatctattacatcactgcagatagttatattgctgctaaaaactcaccgcacttagagctgttcaataagaaagatattgaagtattgttgttgtctgatcgaattgatgaatggatgttaagttatttaactgaatttgacggtaagcaattacaaccgattactaaagctgatctggatttaggtgatttagcggacaaagaacaggaagagcaaaaagagcaagataaaacctttagttcgtttattgaacgagtaaaaaccttgttgggagaacgtgtaaaagatgtacgtttaacgcatcgtttaacggataccccagcagtggtttctactgataatgatcaaatgaccacgcaaatggcaaaattatttgcagcggctggacaacctgttccagaagtaaaatatacgtttgaacttaaccctgaacatcatttagtgaaaaaagtagcagatttggctgatgaagacgaatttgcaaattggattgaattactgcttgaacaagcaatgcttgctgaacgtggttcattagaaaatcctaccgcatttattaagcgagtaaacaatttattggggtaatggttgtttcttagctgattgatgtaataaaactctctaatttattagggagtttttttatctatgtttgacacttgtagtaaaaaagtgcggtagtaaaatagcatttgaatagttaaaaaaatgctaacaatggaattttcacgtataattcggaatcgggttttattgaccttttatagaaggattgttgatgaaaaaaattatcttctttggcactgttatttggctcactgcttgtacaacaactaatttaccaccaagttgccaacgttatttcaatgcactggagaaaaacatggcacaattttctctgtcaaatgctgaattggctaagtttaaacaaaataaaaataaattaagccaattaccggaaaaagaacaaaataaaatttgccttttaagaatggcaagtatgcaacaatataaaaattgatcgtttctgatgtgttcaagtctttttacggaataaatatgactacttttgtcgcttggggcaatattcaacaatcgtatccttttgaaacaatacctttgcagttactgaatgaaaaactgacgcatttagcaagtaactatacacctgtgcggcaacgttatcattgtcgccgtttggcacattttttattgtggcaattgttgcaaaaagccggagtgaataccgcacttttaggcgatattaaacgttcttcatctaatcgcccttactttttacaaaaccatattgattttaatatcagtcattctgatgattgggtagcagttgttttacaagttgatgaaaataatgataaaagtgcagtaggaattgatattgagtttgtcaaaaaaacaagaaattacaccgcacttttacagcattttgccagacggcaagaggtgatttggtttcaacaaaagccttgcgaggcacgtttttatcaaatttggtgcggacgagaggcattgttgaaatcgcagggcgtaggtattgtcaaattatcggaagtcaagcatgaaccggagaaattattacttcattccgattattgcccaacgggaaagctcatatttacggctgagttgcctttttattttgcacttttttgtcatcaacatattgaacaaacacaatattttatgtggcaagataaccggtttgtttcaaaaaaactgacgcaggcaattgaatatcaagtgaatcctttaaagcagttcattcaaatttaaagtcggttttcgttgcataataaaaatgaggtagagtattgctcaaattgaatttacgaagattaaattatcaaaggacaacagagtcatcgtgaaattgcggtagaaattcaggactttttaagtggtaacaaaaagcctcatcaataaaaatgaattgataaggctagaaaatttggtggagataatcgggatcgaaccgacgacctcttgaatgccattcaagcgctctcccaactgagctatatccccgtaaactgaatgtggcggctatgataaattccgccacacgtactgtcaatatagaatattaaatattttttttaccagcttaaatattaagcattttgtgtatgaataaaggcaatcgcattatttattctgctaattgtacgatctttaccaaccaatttcgctgtaatatccattgatggcgattgtcccaaaccggttactgccaatctaaatggcatacctactttacccataccaatatcaagctcttgggcggtttggttcattgcttcatgaatattttcaactgtccagtctgaaagtgcggtgagtttttcagccaatttagctaatggtttaatcgcatcaggcttaaagtttttagctacagctttttcatcatagttttcaaaatcttggtaaaaataacgacttgaggttgctaactcttttaatgttttacaacgttcactcaaaacaggaacaatctcagctaagtccggaccattactataatctatgccttgttgcttcatatgccattccaaatgggtcgcaacctgctccgctggcagagaacgcatataatgttgattcagccattgtagtttttcagtattgaatgcacttgctgatttgctaaccgaatgaatatcgaaaagtgctatcatttcttctcgactaaaaatttcttgatcaccatgtccccatcctagacgaacaagataattgattagtgcttcgggtaaataaccttcatctcgatattgcataacacttaccgcaccatgacgcttagataatttttgaccatcatcaccgttaatcatagagacatgagcataagttggaattggtgctcccaatgccttaagaatattaatttggcgaggtgtattattgatgtgatcttcaccacggacaacatgcgtaattcccatatcccaatcatcgacaacgacacagaaattataggttggcgaaccgtctgtgcgacggataattaaatcatctaattcacgattgctaatttcaatacgcccacgaacggcatcatcgaaaacaactgtaccttccgtcggatttttaaaacggacaacgtgaggtgcatcaactgggtattcactttgatgtaagcagtagcgatcatagcgaggtttttgtttattttgctcttgactatgacgtaggtcttccaaacgttctttagtacaataacaacgataagccaatccttgctcaatcatctgatcgattacttggttatagcgttcaaaacgttttgtttgaaaatacggtccatgttcccacgctaaattaagccattccattccctctagaattgccgctgttgcttcaggggttgaacgttctaaatccgtatcttcaatgcgtaatacaaattctccttgattatgcttggcatacaaccaagaataaagtgcggttcttgcaccgccaacatgtagatagcctgttggacttggtgcaaaacgtgtacgaactttagtattgggatctaaattaaaaagtggttctaatttcattcattttgcctttatttaatcaatcataaaacggtgcttattgtacaatgagttatttaatttcataagaaaaaattaaaattatgtttatttttaagacagttaaatagaaatccataaaaaatcattgactgttttttgataattcttataatgcacctcgcacaatacaagggcgattagctcagttgggagagcacctcccttacaaggagggggtcactggttcgagaccggtatcgcccaccactattctatagtgaactttgtattgtaatattggcttaaggggcgattagctcagttgggagagcacctcccttacaaggagggggtcactggttcgagaccggtatcgcccaccactttagccggatttcccatttgactttaagtcaaatccgatagctgaaaagcaatttgattctatcgggcgattagctcagttgggagagcacctcccttacaaggagggggtcactggttcgagaccggtatcgcccaccaattcaaaaaatctaaatttttccacgttgttaaacttattacaactttcgggttgttgtcttttttatctatatttttaactaattattgttcacttttgcgatcttgatcgtaaaactacgatacttgtaaaaaagttttttcctgattccattaaaattattttttatttaacgaataggaaaacatatgcagaatttgaagctattttcttggaaagccactaattttttacagcaaaaacaagctggaatgcttgttatcgaaaatgtacaagaggccaaacgctatttattacaacaagggctaaacaatatatatttacagcgtcattggcaactgaataaaaagcctaaaaaaatagaattttgtgatctattaactcaactagcaatgttattacaatcctcaattcctttaaaagatagcttacaaattttattgagaaattgtgttaatatttctttaaatcaatgggttagatatattttaaaaaatcttgaaggaggattatctttttcacaatctgtggctcaatcaggtctatatttttcttatcaagaacgccaactcatttctgttggagaaatgacgggagatttagcctctgtttgccaacaaatagcagaacatcgtcagcaggcattagcattacaacgcaaaattcaaaaaattttactctatccaatgatagttttaagtatttctatcattctcaccgcacttctattaatttttatcgtgccacaatttgccgaaatgtacggttctaatcaatccgagcttcctttttttacgcaactattgttaaacatatcctcttttttacaacagtatttttttcatatgatagcggtatctattttatttttttatctaataaaattacgtttacacaattcatatagttttcaactcaaaaaagattggtttttatcgcatgtgccgttgttaaataaaattattcggcttaatagaacgataagtttttgccgtagtttaggattaatgctcaactcaggcattcctttacaacaaagtctatattctttccttccccaaaactctatcaacatacagaaaaagattgagggagatctcacgttaattaatgaagtaaagctaacattacgtggtatcgaacaaggatataaattctctcagtctgtaagcagtaatttgttttctatacaaacacaacaaatgctacaagttggtgaaaagagtggaaatctaggtttaattctgcaacatatcgcagaaaatcagcaacaacagttagatcatcaaattgatttactttcacaaatgttagaaccgtttatgatggtgatcattggcggattaataggcttgattatgttaggtatgtatttaccaatctttaatatgggaagtttaattcaatgatttatctagcttatatgttgtttggtggactttgtgggttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggcttttcggttttttatcttatttacattgttgcaaaattattctatcgttatgaagctttaggacgtggtgattactggttaatgttagggttagggagctttatatcttggacaaaattaccgttgctcatttttcttgcctgcctcacaggattaatatatgtcgtttttaatgcaagagacaaaaaaacaatatttattccttttgccccgttcttatgtctctcaaccattatcgtatacttgcttaattttctaagggaggatattcttccttaaattttagggaaagaagaatatggcttatattgtagggttaaccggtggtatcggtagcggtaaaagtaccattgcgaatcttttttcagaactaggcgtacctattgtggatgccgatgttgtcgctcgagatgttgtagcaaaagattccttaatattagagaaaattattgctcattttggtgaagaagtgcggttggaaaatggtgagttaaaccgatctgaattgcgtaaattggtatttcaaaatgaaaaagaaaaattatggctaaataatttgttgcatccggtaattagagaaaaaatgctacaacaattacgctctgttaattatccttatgtgctttgggtcgttcctttactcattgagaataagctaatgaaattatgcgatagagtactggtaattgatgtagagcctgaactccagattttacgagcaagccggcgggatagtaattcgattgaattgattaaacaaatgatacagtcgcaagtaaatcgtgagttacgtttaagttttgctgatgatgtcattgaaaataatctaccccttgaaaaaaacgtggctaatttaaaacaaagcgtagcaaaattgcaccgcacttatttgcattatgcgaagataatttctagaaatagtgaagaatttgaggatataaaatgattgatgaaaaatttactgtagcctgtcccaattgcaaaaaagaagtactttggtcagaggaaaatcgatttcgtccattctgtagcaaacgttgtcaattaatcgacttaggtgaatgggctacagaagaaaagattattcccggttcagaaataaccttgttaccgaacgatgaatttaaagaaaattgagagttatgaatggatarataaataaatagataaaaagaatattgagattttaatttgggcttgttagaatcagcccacttttattttgataaataaaaatatagttcgaatgaaggtagctggagaatggggaattgaccccaaaccgacgaggtaaaatctttcaggtgcgatggcgaggactgttactggacgaacccttggagagatccaatgtgcaatgcacaaaatggacgccgaaggcgcaaaagagcggtgttttttactgcttttcaaacgctcaggcaaaaggacaggggcaaaagattcttttcggatagaaacgttgcatagcgttttttctttattatcccaaaaacttttcgcctccttgtaaacacacgttattttacgaggaatacttatgtcattagagataattttatcgtctatcaatacttttgtttggggacctcccttacttcttcttttatttggtacaggtctttacttgaccttacgcttaggatttattcaaattcgttacttacctcgtgcattatattatttatttgataaagaacgtcatgtaagtaaaaaaggggatatttctgctttcgcagccctttgtacggctttagcggcaacaataggtacgggaaatattgttggtgttgcaactgctttgcaagccggtggaccaggggctattttttggatgtggttagttgctttacttggaatggcaactaaatatgctgagtgtttattagcggtgaaatatcgggtgcgagataaacaaggttttatgagtggcggaccaatgtattatattgagaaaggcttaggaataaaatggcttgccaaattttttgccgtctgtggtgtattagttgcatttttgggcattggcacttttcctcaaattaatgcaatcacgcatgctatgcaagatacctttaacgtatctattgaaattacagcaaccattattaccgcacttattgcacttattatcttaggcggtgttaaacgcatttcaacagttgcatctattatcgttccttttatggctgttttatatgtacttacgtctttgttaattcttatactaaattggcaacaagtaccaactgctataggattaattattcatagtgcatttgatcctcaagcagcattaggcggtgtatttggatatactgttctgaaagccattcaatcaggatttgcaaggggtattttctctaatgaatccggattaggtagtgcaccaattgcggcggcagcagctcaaactaaagaacctgttcgtcaaggattaatttcgatgataggtacttttttagatactatcgttgtgtgtactatgacaggtatcgtgcttgttttaacaggtgcatggcaatcacaagaattggcaggagctgctttaactaactatgcattttcacaagggttaggaaataatattggtgcaacaattgtaactgtagggttactgttttttgcttttaccactattttaggttggtgttattacggagaacgttgttttgtttatttggcaggtgtcaaaggtatcaaagtttatcgttcaatttttatacttttagttgcctgtggtgcctttattaaactggaattaatttggattttggctgatattgtgaatggtttaatggcatttccaaatttaattgctttagttggattgcgacatattgtgatcaatgaaactaaagattattttattcgcaggaaacaaatatttgttgagccaaataatgtagctaattgagcaaaaattaaaggggctgacggcccctttaaatttctctacatcagaccatcatatcaacctcaaataaaaataaaagtgattttttataaatatgataagtagatcatactttttcatttttattcctaaaaagtgaaaaaacaccttgaaaactcctgctaagaggactattttgtaactaagaatttttctgagtggaaacgctcatcaataagcaaaagaggtaaaagctatgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttattcgcaagtagcgagtctgatgatatgtacaaagcaattaacgaagttgaagaaaaattagaaagacaattgaataaattacaacataaaggagaagctcgccgagctagtgaaagactaaaagactcgttttgataaatgagtttgtctaaaagtagagtgaaaataaaacgctctatttattgtgtaatgaattttacttattgtatgttacctatttgaacctaccaaataagtagcgtaaatcgtggcttctcgtaagtcctaaaaaagctgatgtttaaacttcagcttttttgttagaatatatcggcgataaattttattaaggaatgaagatgaaaaaacatcatgttgacgttttaattactgaggaagatgtacgttcacgtattcaagaattaggtagagaaattacacaattctatcagcataaacacgtaaataaattggtagttgttggattattacgtggttcatttatgtttatggctgatttagtaagagaaattaaattaccgattgaaattgaatttatgactacttccagttatgggaatgaaatgacaactaatcatgatgtacgaatagctaaagatttagatggcgatattaaaaatgaagatgtattgattgttgaggatattattgatacaggatataccttagaaaaagtgcgggagattttattgctacgttcgcctaattcattagcaatttgtactctattagataagccatctcgccgagaggtagacgttcctgttgaatgggttggatttactattcctgatgaatttgttgtcggctatggtattgattatgctcaatgttatcgtaatttaggctatatcggtaaagttactttggaagaataagttaccgaaaaggaaatgtttctatcaaaaattaaacaaaaaaagagattaaaaaatctctttttttacacattctttaagaaaaaataactatatagataaaattgaaaataattagaaattatcttcaagcattgttaatttttttctcaaagcgttcagcagcagcatcccaattcaccacattccaaaatgccttgatataatctagacgacgattttggaattttaagtagtaagcatgttcccaaacatctaataccaaaatagggaaaccttcgcaaccggcaatttcttttcccattaatggactatcttggtttgcggtagaaaccacttctaatttgccttgatttaatactagccaagcccaaccggaaccaaagcgagttgcagcggctttctcaaactcagcttggaaactctctactgaaccaaaatcacgctcaatagcgtcttttaatgggccttgtaaagttgtacctgtttttaaacctttccaaaataaactgtgatttacatgcccaccaacattattgcgaatagcagtacgtttatcagcaggaacttcgactaatttggtaattaattgacccggacaaagatctgtaaactcaggtaaagtttctagtgctgcatttgcattattaacgtaagtttgatggtgtttactatgatggagttccatagtttgtgcatcaaagtgcggttctaaagcatcataagcataacctaattcaggtaaagtataagccataacaatttccttctataaaaaattctgaataataaactcggcgaattctagcaaaaaatttgatcaagatcattaaaagtttaatttttttaaaaagccctaccgcaagataggactataatagattaaaaaacattcaacgattctgtgcttttaccgctgcaacggctaccatattaataatacggcgtactgatgaagcagaagtaagaatatgtgccggtttttccacacccattaaaattggtccaattgtaattggtgttgctgtaccttgtaataaattcaagctaatacgggcagtttccatgttgggcataatcaataagtttgccgcccctttaataggactgtcaggcatcacttccttacgtaaattctccgataaagcaatgtcacagtgcatttcaccatcaataatcaaatccggtgctttttcacgcacaagctctaaaacttgccgcattttaaccgcacttgggtcattaattgagccataatttgaatgtgaaacaagagcaacctgtggctctataccaaaacgacgaacttctttggctgacataatcgtgatttctgcaagttcctcggctgttgggcttgagttcacaaaagtatctgcaataaataaattaccggtaggcaaaaccagtccgtttaccgtagctggaatttcatgttctttttcaccaacaacttctttaattgtagttaaatgtgcagcaaatggtccaactaatccgcaaatcattgcatcaactttacccagttccaataaaactgcaccaagtgcggtcggattatgaagcattttgcgtttcgctccggtaggtgtcataccttggcgttttaatttgttgtaataagtatcacaacattcctcgtagtatggattattttcaatgtcaataatctcaaaatcacgtccgagctgtaattgcaaacccaattttttaatactttcctcaataatatgagtacgacctaataggacaggataggctatgcctaaggttgcaatttcttggattgcatgtaacacacgtttttcttcgccatcagttaaaataacacgttttttatcttctttggcttgtgcaaaaacaggtttcatgaataagttggttttataaacaaactgagttaatttctcaatgtacgcttcaaaatcttcaattggacgagtagcaacaccgctatccattgccgctttagctacggcgggtgctatttttacaattaatcgaggatcaaacggttttggaataatataatccggtccgaaagaaacaccgctctcaccataggcggaactgacaacctcgctttgttctgctaaggctaaatcagcaattgcataaactgccgcaagtttcatttcttcattgatagtcgttgcactgacatctaatgcaccacggaaaatgaacgggaagcataacacattattcacttgattcggatagtcggaacgaccggtacaaacaatcgcatcaggtcgaacagcttttgctaatggcggtaaaatttcaggctcaggatttgctaaggctaaaattaaaggattaggccccattgtttttaccatttcttgagtaagtgctccagcggcagaacaacctaagaaaatatctgaatctggaatggcatcagctaaagagcgttgaccgttatcatcaatagcatataactttttggtgtcatccatttttttgtcacgacctttataaatgacccctttagagtcacaaaccgtgatattttcacgtttcatgcctaatgaaaccaataaatttaagcacgcaatcgatgctgcacctgcaccggaggcaactaaacgaacattttcaatttttttattaacaatacgtaatccgttaattattgcggcggctgaaataatggctgttccatgctgatcatcatgaaaaacaggaattttcatacgttcacgtaatttctgctcaatataaaagcattccggtgctttaatatcttcaagatttatccccccgaaagtcggttctaaagcagcgataatttctaccaacttatcaggatcttgttcatctacttcaatatcaaatacatcaacaccggcaaacttcttaaataaaacacctttaccctccataacaggcttaccggctaacgctccaatatttcctaaacctaatactgcggttccatttgatatcactgcgactaaattgcctctggaagtatatctataagcagagacaggatctgcttggatttctaaacaaggtacagccacccctggagaataggctaaagctaaatctcgttgtgttcccaatgattttgttggtgtaacttcaatttttcccggttttggaaactcatgaaaatctaaagcggcttgacgtaattgtgcatccataatttttcctcatattaactatttacttcatttcaactttactaaaaaccaatttcattataggcaaaaaaataggcaaaaaagtaacacgaaaattttatttacataatttaccaaattgtatgatatatagaatcaaatacaaaaataggcatatatttttactatatgcctattggaactaaagaacaattttacttatgtaatgtagctttgtaggttgggttcattaaattctccacagaaagaatattatctaactgctcttctgttaataagcccatttccagtacaacttcacgcactccacgtcctgttttagcacatgttttacctactatatcgccattatgatgaccaataaacggattcaaataagttacgattccgatggaattaaagacataattttcacaaatttctttatttgcagtaattccatcaatacatttatcacgtaaattcacgcaagcatttgttaaaatttcaatactttcaaacatggcttgaccaattaccggttccatcacatttaactgcaattgccccgcttcagctgcaaaagttacggtagtatcattaccaatcactttgaaacaaacttggttgactacctcaggtacaaccggattgacttttgccggcataattgaagatccagcttgtaactcaggtaaattaatttcatttaaacctgcacgtggacctgatgaaagtaaacgtaaatcattgcatactttagataattttaccgcagtacgttttaacgcaccgtgtaccataacataagcaccacagtctgaagtggcttcaattaagtttggtgcaactgtacaaggtaaacctgaaacctcagataaacgcttaacaactaattctgaataaccttgaggagtatttaagccggtaccgatagctgttgcacccaaatttacttctaacagtaattcagccgtgcgggttaaattacgcacttcttcatctaataatacagaaaacgctttaaattcttgccccacagtcataggaactgcatcttgtaattgagtacgtcccatttttaagatattcgaaaactcttttgctttattttcaaaaccctgttgtaaataaagtactttagttaccagtttcataatactgttataaacagcaatgcggaaacctgtcggataagcatcatttgtagattggctggcattaacatgatccatcggatctaaaatatcatattcccctttcttatgacctaaaatttctaatgctaaattagcgaccacttcgttggtattcatatttacggaagtaccagcaccaccttgatatacatctgaaggaaattgatccatacatttaccatcaattaaaatcgcatcacaagctttcacaatcgcctgagcaattttatccggaattgcacccaattctccatttgcaagtgcggttgctttttttaccatgaccataccacgtacaaattcaggtacatcagaaatcgttacattagaaatgttaaaattttctaccgctcttaatgtatgaatgccccaatacgcatctgctggaacgtcacgttcaccaagcaaatcaatttcttttctcgttatcatatttctttcctttttaatttttcagactaaagaatgtaagtcattataggatagatagtcgtttaaaaatgtgatcccgatcacttttcagcactcctctcaccaatatattttttataaaattcattagttttttttatggaaaattaaataaaaaatacccttgaaagaaccaaaatatcccccatatagggtgagctttaattttttattaattattaataaggaacccaaacaatgaatattcgtccattacatgatcgtgtcatcattaaacgtgaagaagtagaaactcgctctgcgggtggtattgtcttaaccggctcagctgcaacaaaatccactcgagcaaaagtattagctgtgggtaaaggtcgtattttggaaaatggtacagttcaacctcttgatgtaaaaattggtgatactgtgattttcaatgatggatacggcgtaaaagcagaaaaaattgatggtgaagaagtgttaatcatttctgaaaatgatattttggcaatcgtagaataaaaacaaattaaattaataggaatacagaaaatgacagcaaaagacgtaaaatttggtaatgatgctcgtgtaaaaatgctagcaggtgtgaatgttttagcagatgcagtaaaagttactttaggacctaaaggtcgcaacgtaattttagacaaggcttttggtgcacctactattactaaagacggtgtgtctgtggctcgtgaaatcgaattggaagataaatttgaaaatatgggtgcacaaatggtgaaagaggttgcctctaaagcaaatgatgctgcaggcgatggtacaaccacagcaacagttttggctcaagcgattgtcagcgaaggtctaaaagcagtagcagccggaatgaatccgatggatttaaaacgtggaattgataaagcagttaatgcagtggttgaagagctaaaaattctttctaaaccttgtgaaacgtcaaaagaaattgaacaggttggtacaatttccgcaaacgccgatgaaactgtcggtaaacttattgctcaagcaatggaaaaagtcggtaaagagggggttattaccgttgaggacggttccggtctttcagatgaattggatgttgttgagggtatgcaatttgaccgcggttatttatcaccatacttcattaataaaccggaagccgcaactgttgaattagataatccgtttattcttcttgttgataaaaagatctctaatattcgtgaattattaccggtcctagaaggtgtagcgaaagctggtaaaccattgttaattatcgcagaagatgtggaaggcgaagcacttgcaacgttggttgttaacacgatgcgtggtattgttaaagttgctgcggttaaagccccgggatttggagatcgtcgtaaagcgatgttacaggatattgctatcttaactgcaggtactgtcatttcagaagaaatcggaatggagcttgaaaaagcaactcttgaagatttaggtcaagcaaaacgtgtggtgatcaacaaagataacacgactattattgacggtattggtgatgaagctcaaatcaaaggtcgagttgctcaaattcgtcaacaaattgaagaagcaacttccgattatgataaagaaaaactacaagagcgtgttgcaaaattagccggcggtgttgctgtcattaaggttggtgcggcaactgaagttgaaatgaaagagaaaaaagatcgtgttgatgatgcgttacatgcaacgcgtgcagctgttgaagaagggattgttgccggtggtggtgttgcattaatccgtgctgcaacaaaagttgcaacaacattaaaaggcgataacgaagatcaagatgtaggtatcaaacttgctttacgtgcaatggaagcaccacttcgtcaaatcgtaaccaatgcgggagaagaagcttctgtagttgcaagtgcggttaaaaatggtgaaggaaacttcggttataatgctggtacggagcagtatggtgatatgatcgcaatgggaattttagatccgactaaagtaactcgttccgcactacaatttgctgcatctatcgcaggattaatggttacaactgaatgtatggtagccgatctgccgaaagaggagaaagctgatctgacaggcggaatgggtggtatgggcggaatgggcggtatgatgtaattctccccatattccatatctaatcattatgttaagaagggtcgtcagaccctttttatttttcaaaaaacgtagaccttaattattagctatctagaagtctagattgttattttgcctattttttattagaatactcaatattactaaggttattaaggatcaacaaaatggcagattgggacggaaaatatattagcccttatgcagaacatggtaaaaagagtgaacaagtcaagaaaattaccgtttctattccaattaaagtattagaaattttaactaatgaacgcactcgtcgccaactccgtaatttacgtcatgcaacaaatagtgaattattgtgtgaggcgttcctgcatgcttttaccggtcaacctttgcccacagacgaggatctattaaaagaacgtcatgatgagattcctgaaagtgcaaaacaaattatgagagaattaggaataaatcccgatgattgggaatattaatagattaagtttggtaagttatttcagcaagtgcggtcgttttgaccgctttttcgctttttattagtgaatttcactcgggaatgttacaatccgctaccgttataacaatagagataaatacaatggctcgtacaaaaaaaactcgtcgaataacagatattatgcccatgcgtaaaacagataaacgtccggaaaatctgtcacgccccggtaagaaacttactcgttatgaacttgatgctaaatctcgtgaagaaaaaaagaaaaaaaaacgtaaaggactaaccgctggttcacgtcatagtgcagtagatacaagtaaaacaatcgtacttaatgaaaaaaaagatcctcgtgttgggagtcgtaaaaaagttcctcttattgttgaatttgtgaataaacctgaaaaaggtatgtttattccttcaggtgctttagaggaaaaagcgaaaactattgatccgatgctggaactgacacaactcgaaaataatgaaagtttaaatcaattattagatgagcttgatgcaggtaaaaccttaagtaaaaaagatcaaatctttgtcaatcaatgcctagaccgtattgctcaacttatggctgaacttggaattgaagaagaaaatgaagatgatttgtaccgcacttttgagactattgatattaaccaatttaaataagctatgtggatcacaattttaatcattctcggcggattaattattagcgttatgcttggttacgcaatatatttattgctcgttttacaaaagcagaagaaagtttttttgcaagcaaaacaggctagactaaagcgtttaaaagaaagttgtgaaattatcgctaatgcaatgcaaagtggagaatgcaatttatctgaaggtgttatccgtctaaaaatgttgcttgaaccgttagggcattcattgaaaaattacacttcaatgtaccaactctatgaagcagtaatggatatgccgacccatgatgctcggcgaacattaaagaaaaatgaacgtatgcgtttagatttacaacgtgaacgtgctgaagctgatttagaacaaaacatcaaacttgaaattcagcgactgttaaattacctaaaagaatctaaggaaaaataaatgtcagaaattatctgggatttagcattaatccaaaagtataaccattcaggtccaagatatacctcctatccaaccgcacttgaattcaatgaaagctatactgataaagattttcagcaagctgctactcgttatcctacacgtccgctttctttatatgtacatattccattttgtcataaactttgttatttctgtgcgtgtaacaaaactattactcgccatcaacataaagtagagatttaccttgattatttagaaaaagaaattcaaacaagggctccgttatttcgtcatcgcatcgcaactcaaattcactggggaggcggtacaccgacttatctttcagaacaacaatctgcacgtttaatgcaaatgctggaagagaattttactatttcagataaggcggaaatcagtatagaaatggatcctagagaaattgagctttctatgctggatcatttatacaaaattggttttaatcgtattagtatgggggtgcaagattttaataaagatgtgcaaaaagcagtgaatcgtgaacaagatgaagaatttgtgcgtgaattgttgattcgtgctcgtgagttaggttttcgctcaaccaatctcgatcttatttatgggttaccgttccaaaccgtagaaagttttatgtttaccctacataaagttatcgaactcaatccggatcgtttgagtgtatttaactatgctcacttaccaagccgtttcgccgggcaagcgaaaattaaggataaagacttaccaacacctgaaacaaaactaacaatcttgcaaaaaactatcgaaacgttaggacaagcaaactatcgttttattggcatggatcattttgctaaaccggatgatgaattggcaattgcacaacaaaaaggaattctacaccgcaatttccaaggttataccacgcaagaagaatgtgatttattaggtttaggtgtttctgccattagtttattgggcgatacctatgctcaaaaccaaaaagatctcaagcaatactatacccacgtagaagaaactggtttagcattacacaaaggtttggtgatgacgcaagaagactgcctacgtcgtgatgtgatcaaacaattaatttgcaattttaaattagattttcaaccgatagaacaacaataccaaattgatttcaaaacctattttgctgaagatttagctttgctccaacccttagcaactgacggcttagttgatattaatgacaatgcgttacaagtatctgctaaaggtcgtttgctcattagaaacatttgcttgtgttttgatacatactccagacaacaagcaaaaagacaacaattttctcgaattatttaacgaaaaagtgcggtcaaaattaaccgcacttttttaacctcgctgtgcatttttcataatgcgatctttcgttactttccattcacgatctttaatatcttcacgcttatcatgtaattttttcccttttgctaaacctattttcacctttgcccaaggacctttccaatataatgaaagtgcaacaatagtgaaaccatctcgatttgctttaccaaataatgaagccaactctttctggtttaataaaagtttacgtgttcttgtgggatcgcaaacaatatgcgttgaagcaacacttaacggctgaatggttgcaccaaataaatatgcctcgccatgcttaaaaataatataactatcgccaatactcgccttacctgcacgcatcgatttaacttcccagccttgcaaagaaagaccggcttcgatttcatcttcaataaaataatcgtgtcttgctcgtttatttaaggcaatcgtattagatgctacctttgcttttttctttgtcatataaattcatatctcattaaaaatttttcgcattttacccaatctaagcaaagatcgcaaaaaggcttgcattacatcgcattctctataacaatgcggatattcttgataacccgttacgcaaaatatgaaatataaaaatctacgagattttcttgaattattagagaaacaaggtgagctcaaaagaattacacaggaaatcgacccttatttagaaatgacagaaattgctgaccgcactttgcgtgccggtggtcccgcattactttttgaaaatccaaaaggctatgaaattcctgtgctttgtaatttatttggtactcccaaacgtgttgctcttggaatggggcaggaagatgttaccgcactgcgtgatgtagggagattactggcttttctaaaagaacctgaacaaccaaaaagttttaaagatttatggtcaagtcttcctcaatttaaacaagtgctaaatatgccaacgaaagttttgagtaaagcagagtgtcagcaaattgtattctctgatgctgaagttgatttatataaattacctattatgcactgttggaaagatgatgttgcacctttagttacatggggattaaccatcactaaaggaccaagtaaaaaaagacaaaatttaggtatttatcgccaacaattaataggaaaaaataaactcattatgcgttggctatctcaccgtggcggtgcgttggattttcaagaatggaaagaagcacgccctaatcaaccctttcctatttcagttgctttaggggcagatcctgccactattctaggtgcggtcacaccagttccggatactttatcggaatatgcttttgccggattattacgtggtaataaaacggaagtggtaaaatcaatcagtaatgatcttgaagtacctgcaagtgcggagattattttggaaggttatattgatccaacggagaccgcacttgaaggtccatacggagatcatacgggttattacaatgaacaagaatattttcctgtatttaccgtgacacatcttaccatgcgtaaagatcctatttatcattcaacttacacaggtcgtccaccggatgagcctgcagttttgggtgaagcactgaacgaggtttttattcccattttgcaaaagcagtttccggaaattgttgatttctatcttcctccggaaggatgctcttaccgtcttgcagttgttacaataaaaaaacaatatgcaggccacgctaagagagtcatgatgggagtatggtcatttttacgccagtttatgtacacaaaatttgtgattgtctgtgatgacgatataaatgcacgagattggaaagatgtgatttgggcaattacaacacgtagcgatcccgcccgagattgtacaattatagaaaatacgcctattgattatcttgattttgcctcaccgattgccggtctcggctcaaaaatgggaatagatgcgacaaacaaatggattggagaaacgcaacgtgaatggggaaccccaattaaaaaagcccctaatgtagttaaacgcattgatgatatttgggagagtctaaatatttttgctcccaaataaacagcaaaaggtaaataagtgcggtgcttatttacctgtttattttaaacgctcaaatccggctttaagatcggcaataaggtcatcaacgtcctctaaaccaatatgtaggcgaattaatgtaccggttaatttgcgttcaatattaggtctaatcctagcgatttcttccggttgattgcataaaatcagcgattcaaatcccccccacgaatatgccatagtaaaaatcttaaaatgatccataaaattttctaacgcctgttgagaaagttttttatttagttcaaaagaaaataatccgctggaacctgtaaaatattgcttaaaatattgatgtcctggacaacttggcaatgccggatgataaacagtttttacttcaggttgttccagtaaccatttagctactttaattccattttcttgatgctgttttaagcgaactagtagagtacgaataccacgggctgtcatgtaggcggtatcagcatcgaccatctgccccattaaataagaattttcacgtaattgttcccaacaacgtgcattagccaccgctgtaccaatcatcgcatcagaatgcccaatgagatattttgtcccagcctgaattgaaatatcaataccaaaatccaaagccttaaaaaatacacctgcactccaagtattatcgatcataactactattttaggatttatttggcgagcagcttgcacaatcgatacaatgtccggtatctccatagtaagtgaacttggtgcttccaaaaacaagactgtcgtatttggttgaactaaatccacaattttttcaccaattaaaggatcataaaatgtggttgtaattgacattttctttaaaattatatgacaaaattcttgcgttggttcataagcagcaccgctcattaacacatgatcaccggtttttacaaaagctaaaatagcattacttaccgccgccgcaccgcaaggatagagatagcaaccctcaccaccttccaattcacacattaattcttgcaaagcaaaatgtgtcaatgttcctcgacgtccataaaataatccaccttttgctcgattgatagttgcttgttttttatctgctaaagtatcaaaaaccaatgaagatgcacgctgaataacagggtttaccgcatttttacatactcgtttattacgccctgcatgaattgttgatgtggtaaaagaagttgtattactcatagaaatatccattttaaacaaaaatcaagattataataattgatttaatagtcaaaaactaatacaaaagtgcggtcttttttcataaaatagttgtgcgaatttgctttagaatgcaaaattcttaataacttttataggagatttttactatggtattagttactcgtcaagccccagattttaccgcagcggcagttttaggcaatggtgaaattgttgaaaaatttaatctaaaacagcatattgctgggaaagcggcagttgtttttttctatccaatggattttacttttgtatgcccatctgaattaattgcatttgatcatcgttataaagaattccaagatcgtaatgtggaaattattggtgtttcaattgattctgaatttacacacaatgcatggcgtaacacaccggtagataacggcggtattggtcaagtacaatatgctttagtggcagatattaagcacgaaatcgcaaaagcttatggcattgaacaycctgaggcaggtgttgcattacgtgcrtcattcttaattgacaaagaaggtgttgttcgtcaccaagtcgtaaatgatcttccattaggtcgtaatattgatgaaatgttacgtatggttgatgccttacaattccatgaagagcatggtgaagtatgtccggcacaatgggaaaaaggcaaagaaggtatgaccggtagcccagaaggtgttgcaaaatacttaaaacaaaatgcagataaactttgatctcatsaaktttaactaaaactasccccgyacttatgtggggytrtttyattataaatctagtyattcttataagatcctctgaaaaatagaaataacattattagcaataattttccatgaggatatacaaaaaagctcccaaaataaattttaggagcttcaaattttatttcataaataattagcgacgtaagcctaaacgtgcaattatttctgaatatttagcaagatctgtacgttttagatagtctaaaagtttacgacgacgagagaccatgcgtaataaaccacgacgaccgtgatgatcttttttatgtgtagaaaaatgagcttgcaaatggttaatttgtgcagtcaataatgcaatttgtacttctgaagaaccggtatctttcgcatcacgaccaaattcagcaacaatagctgcttttttttctgtacttagagacataaacattccttatactaaaagggttgataatacatcattcgccgatctctaactcagcgatgacaggaactgcagattctatctctcgattataaaaaaagcaataaataattactcaacatacaaactagacctacttacaatgttactgcattatttatgcgtattatgcgtaaaaactaaaaacgatagatatatttttcttgattttatagcaagaaagacaaaaaatattagctaataggattataattaattaagatatttaattttagataagtggcataagtggctaaacatgttccacataaagtaggataaaaattttctcaatctattcaatcaaatttttggagatttatattatgacaatacaaccagatccaacttctgtaaaaactcactttcaaggcaatgacaaactattgtttggtatgattatgggagtgattgccttttggctttttgcacaaaccacgttaaatattgcacccgatatggagcaagatttaggtgttaacaccagtattatgaatattgctgtatcaattacagctttattttcggggatgtttattgtcgttatgggtggtcttgcagatcgtatcggctgtttaaaaattttaaatttaggttttttattgagtattattggtgcattgttaattgcactggctccatctggtgatttagctgtcccactattaatgttagggcgtattattcaagggatatctgctgcttgcattatgccatctagtttagctttagtaaaagcctattgggagggcgaagctcgtcagcgtgctattagtatgtggtctatcggctcttggggtggttctggtttatgtgcactcttcggtgggttagtatctcaaaatctaggttggcgttatattttctttgcttgtgccgctttatctttattaggttatgttatgtgtcgtggtaccccagaattcaaaatggaagatgatggaaaaaaacataaatttgactggggaggtgttgttacctttatgattgccatgatcgctttacaagtattggtgactcaaggtggtgatttcggctggacaagcatgaccactatcggtttattgctagtgacttttgtgtcaatcgtattatttttatggattgaggagcgtgctgataaagcgtttgtggacttttcactttttaaaaatgcgacttacaccggagcgactatttctaacttcttgctcaacggtgtagccggcatgttaattgtatcgttacaattagtacaattgggcggtaatatgactgcacaatctgccggattgcttactattggctatgcgattgcgattattgcttttattcgtgtgggggagaaattattacaacgttttggtgcccgtacacctatgatttggggctgcctaattacaggcttttctattgctttgttattaccaacgaatatgatgttggatcaatataagattatcgttgttatttcttatatcttgtttggtataggtttagcattttatgcaaccccatccactgatgccgcattatcaaatcttccgcctgaacaagcgggggcgggttccggtctctataaaatggcttcttcacttggtgcggcatttggtgttgctatttcagcggcaattttcaccgcactccgtgcagagaatgccagtgtatcttggttaaataacatcgtcccttttgttggtcgccaagataatattgctattcgtgaagctgctactattgcattaatgtttaacttattgatgatttttggggctattgtgtctattatgttgactgtgccaacgggcaaaaaatcatcctaaccacagtatttacttgatattcaggctacctaaatcattccggtagtctgaaaccctaaaaaacagggttcagtaaagaaaaaatcatgactatattatttacaaactatcaccccaagcaaatcggaaaaatcaacgtatattttccttatatctaccagccactatatatttagtcaaaaaaatctacgtctaaatttattggcggtttagtccaatttttgggtatagatcattttgaccgttctttttattttttgcataatagctactttatttttatccgtctcttacgtatggagcattctatgctgacagaacaatctaaaaaacataccgcacttttgtcttttttacctgtattactcttaattgctattgatttctttaccatgagtttacaagctcaagcaaaagcaatttcccacttgagtttagctgtattagttacacaattattatgtattttagtgtttgccaaaggtgaaatttgcaatggtcaacgtttcagattagtaaaggtaaacttatattttttgatttattgggggttatggctgtttatcagtttattttccaattatcactatgtattaactgatattgtatgtttgtgtggcattgctttaactttggctatttggcaacaacctcaagatttgcaaatgcgtaagtcattgttggttttaggaacacttgtgggagttttaggtatagtaacttattgtttaatgtttattgatttacctttactttatttttctcaatataatccagtagctcaagcattgctaggcatcatattagcgaatttattgctagtcatcgctaaaaatcgtttacaaggctttattatcttattgccttttttgatgctgattactttattactgaatgcaattattgtgttaggtattttgttttttgctatatcacaacaagttgtattttctaatgagttttcttggggactttattttattttacatttacttgttactggcattattgctatacatttattttataaatggaagtttgaatattacgttctgttaataatgagttttattgcgatgagttttcctttgtgggtaagttttgcctatgtgttttaactaaaataactgcctactttttggaaatgattgatcattgatgagtatgtatgttatcagataagagaaaagcggacaaaatgttttattttgtccgctttgtgtaatattgagaggactaaatgttaagtacagcaattaaagctaaaatagagtaaagtactgataatccgtagaaaataatcccacctgctggaatatgaagtttaaaatcatgtgtgccatggtgaattcgatgcattgccccccaagttggaaaaactaatacaactaatagaatcagtttacctaaccaagaaccggcaaaagcaataatattgtctgcaccgttttcgattaatccaaaaggtagtaatagacctaggataaaaatcaatatagggaagacaattgcacttactgtagtacctgcaccgaacaataaccatacaacaggttcgttagagcgttttggagtttctttcatcttggtctccctatttcaagtaaattagcactaaagcaagaatacttactacggctgtaacagcccacataccgatagtaataacattcggatttagtttttcatttttgtacacgatatttagcacttttggcgtcatgaagaaatacgtaactgtattcaaaatggctgctgccaaggcgataatattcagaataataacaattggattttgtaagaaaggaataaaatccgattgcaatccatctttttgacctaggcagatcacgccataaagtaataccaagctaaaccataatgatggaattgctgttgcttcacgcataatgtaaagtttgtaaaaatctagctttttccaccaagttgcttttacttcccgcacatatcttctgcgtttacttgttactgttgtcattttacactccttacttttgcggttttaacattgcaatgacgaaatcttttgcactttcgactttaccttggttgacaccagaagcaggatctacatgtttagggcaaacttcggaacaataacccacaaaagtacaactccatacgccatttttaccgttaataattttcatccgttctgcttttccgtgatcacgattatcaagattataacggtgagcaagagttaagactgccggaccgacaaattcgggatttaagccaaattgcggacaagcggcgtaacataatccacagttaatacacatagagaattgacgatatttctctaattgagccggcgtttgtttagtacgactttccgccaattccgctgacgtatgtggtttaccatctaattcaggtgctttattgcctataatatatggtttgatactctccaaactttcaatgaagtgactaaggtcgaccactaaatcccgttcaatcgggaagtttgctaatggttcaatacgcatatgaccactataatcacgtaaaaaagttttgcaggcaagtttaggtttaccgttcaccatcattccgcaagaaccgcagattgccatacggcaagaccatcgataagaaagttccggttctaatttatccttaatataacctaaagcatctagtaaagatgtttgactgtcataaggaacttggtaagtacgtaagtatggctctttatccgcctcaggattataacgcaatacttcaatattcattattgcttgattagccatttgcttgctccttagcttttgcagccgcttcttgtgcttcagcttccgcaccgtaaacacgttttgctggttgagatttggtgattttcacatcgctgtattcaatccgtggggcaccatcagcattataatatgctaaagtgtgttttagataattcacatcatcacgctcagtatagtctaaacgttggtgagctccacgagattctttacgttcaatcgcagaattagcaatagattgagcaacatcgagaatataacctaattcaacggtatagagaacgttggtgttaaatacgcttgaacggtctgcaatacggatatgtttataacgctcttttaattctgcgattttatccacggtttgttgcatactttcttgtgtacgataaatgccgcaaccttcttccattgaatcgcccatttcatcacgaatttgcgaccaagactctgttccttcttgattgtataactcttctaaacgatggataacatcttgagcttgagcatcgaccgcacttcggttagcaggttgtgcttcaattgcacgctgtgctgcatattcacctgcaacacgtcctagcaccactaattctgctaatgaatttgaacctaaacggtttgcaccatgtaaaccagaagacgcacattcaccaacggcaaataaacctttaatacgggtttcgctattgaagtccacttcaataccacccatggtgtagtgtacgacaggacgaacgggaattggtgctttggcaggatcaacaccttcgtaagcattggctaattcacagataaacggtagtcgttcatgtaaatatttttcccctaaatggcgaagatcaaggtgaacaacatcaacaccttttgctgtttttaacgtattgcctttacgccattcttgccagaaggcttgggaaactttatcacgaggacccaattccatgtatttattttccggttttccgataggtgtttccggtccgagaccataatcttgtaaatagcgatagccatctttattcaccaaaataccgccttccccacggcaaccttcagtcattaagatacctgtattcggtaagcctgtcggatgatattgaacaaattccatatcacgtaacggtacaccatgacgatatgccatcgacaagccatctcccgtaacaatacccccgtttgtgttgaaacggaatgcacgacaaccgcctcccgttgcaataatgaccgcattagcattgatttgtactagagtaccttccatcatattcatcgcaaccataccacgagcatgaccgtcatcaactaaaatatctaatacgaaatgttcatcaaaacgctgaatttgtgggtactgaatggaagtttggaagagagtgtgtaacaaatggaaaccggttttatcagcagcaaaccaagtacgttcaattttcataccgccgaaacgacgaacgtttacatcaccatcaacttttctgctccaaggacagccccaacgttctaattgagtcatttctaccggagagtgttgaacaaaatattccaccacatcctgttcacacaaccagtcaccaccggcaacagtgtcatggaagtgtttatcgtaagagtcctcatccttaattactgcagctgccccaccttctgcagcaacagtatggctacgcatcggatatacttttgaaactaaagcgatctttaaattaggatttgcttccgctgctgcaattgccgaacgtaaaccaccaccaccggcaccaacaattgcgatatcgacattaactgtttgcacgatattcctccaataatagataagagtaaaaattaatccctaacgggaaattacaaaagcaatactattctgccactattttaaaagagatataactcttttttgttaatttaagctagaaaattttaatttcgtgatctaactcaaaactatatttgaaatagataagaaatattctcattagtttaaaattagatgataagcaatatcatttattaacaaaaacatagcgttactattataaaaattgatttgtcgcattattatttttttcaggtagaatatttcaaaaaatttataaaggattttattatgtctttgaatgaacaatggcaacctagtgcctcgatccaaaatttattggcaagagcaaaaattattgcggatattcgtcgtttttttacagagcggggattgttggaagtggaaactcccgtattgagtgaatttggcgtaacagatgttcatctttcgactttcagcacagcctttacatctccgtttatggaaaagtcaaaaactttgtggctaacgacaagccctgaatatcatatgaaacgtttattggcagctggaagcggtgcaattttccaattgtgtaaagtatttcgcaatgaagaaagcggcaaaaagcataatccagaatttacaatgcttgagtggtatcgaccgcactttgatatgcatcgtttaattaatgaggttgatgatttgttacaacaaactcttgattgtgaaccggctgagatggcgagttatcaatttgtatttcaggaacatgtaggtatagatccgttgtctgcaccgattaatgaattgattgaaaaagcaagagaatgccatttggacggtgctgaaaatgaggatcgcgatacgttgttacaatttttatttagcacgcttgtcgaacctaatattggccaaaataaacctattgcagtttatcattttccggcaactcaggcggcccttgcgcaaattagttcagaagaccatcgtgttgcggaacggtttgagttttattataagggaattgaattggctaacggttttaatgaattgactgatgcacaagagcaagaacatcgctttaatcaagataatcgcttaagagaacaattggggttaccacaacatgagattgatcatcgttttttaggtgcattacaagcggggttgccaaatacagctggggtggcattgggagttgatagactcattatgcttgctttaggtgctgaaaatatcagcgaggtgatttcgtttaatatagattgtgcttagaataaagtttttgtatcacattgcgaaaaagaatttttacaaataacggtaaattattctttcaaactaatttgatgtgaacccaaagattgtttacgattaatcattgcatgaactactaattgtgcagttttaatagcatgataaatttcaatactgtgaatctttttgagatcaataggacaatttttttccaaatgttgtagttgtgtaattaaacattgcaaattttttttagttctatacacattggcaaattgattcattaatgatcttacttgtcgcaatatttcacttgatgagtgagcggattttttctcttgattggctaaatgttgtaaatagcgtattccctttaacacataatgttctttattttgtgtagaaaagtgcggtacattttccacaactttttgtatcgctcttttggcaaacacgaggctaccgcctacagagttccctcctagacgatttgctccttcaatacatgcagaaacttcccctaccgcaaataacccctgtactgctgtttgggcgtattcattgatttcaattccaccgttgcaactatgagcaaaaggtcgaattattacctgatctcgcaataaatgaatatccatttctttttccagccaagttaaatagacttgataaaattccgttttatcatggtaaagttcgggagaataatgtagatacactcctttctcagtaggattttcaatcaaatgtttcattattacgagatcaaattcaacactttgaaaatccacactaaaaggtgcatagctactacgttgtcgtatcatttgctgaaattgttgcggtgataaatgagaaaataaattcttacctttgctatcagtaacctttatcagatattttaaagtatgctcaccgaacaatactttatacttaggtttaacaaaagcaggaatgaattgaataaattcaagattggttaattttgcacctgcttgataagctacatagtgggtcgaacctattatatctgcaggatagagattgtcttgatacaaccccgcaataccgcctgtggctaatatgatattattcgtgtagcaaaaaatatagcgaatctcaccgcccttttgttgaacaaaaatagcacctttaatttgattttgttcagtaacaatatgtaataaaacagagttttcataaaattctatttggtgctgaattaaaatttgtttagcccgtttagcactttgtttccagttattaattaaatagatcgggcgagtatagtatgcaaagcaagcagggcggttatcttgtcgtagccaaggagtaaatccaattttactcaatagctcaatagcttgtggtgattcttccacataagccctaacaatcttaggattatttactccacaagcgactctctcaatttcttgttgaaagagaattttgtcatcggaatcccctgttatttgaataccaagtgtcgcttttagcggaaaaaaacttgcacctccacctattattgatttgctaattaaaatcggattaagtccttttgcttttgcctcaacacagcatgctaaccctgcaataccagctccaacaatcaataattccgtttcaatttggtggtgaaatttaatatttgtcataatctataaatcttttattaaagataaattcaatgcccacatcacaaaaatatcagcaatatcttccgcttaattaactactacaataatgatggtgctgcattgagcaaaattttggtatattcctgttgcggattattaaaaacatccattgcatcaccttgttctacaatcaagcctccattcatcaccacaatacgatcagatacttgacgaacagtttgtaaatcatgagagataaacaccattgcgagatttaactcttttttaagatcggcaagtaaatttaacacttgagcccgtacagacacatcaagggcagaagtaggttcatccgctacgattaactttgggtttaatgccaatgcacgagcaatagcaactcgttgtttttgtccacccgacagtcgtgtaggttcaaccaatgctgcagagcgaggtaatcccactcggaaaagaagttcatacacccgtttttcacgttcatgggggtgcagtacattatggatattcattggatcttttaatatatctattactcgcattcttggattaagtgcggtggcaggatcttgaaaaatcactgaaacttgtcgtccgaattgtttgcgagcctctgcacttccgtatttcatctttaaaccgttaaattttactgtgccggaagagggtttttgtaaaccaatcataacattggcaagcgttgatttaccgcaacctgattgtcccactaaacccaaagtttctcctgcctgaatatttaggctaataccatctatagcagtaaattttttcggattaaatattgaaccatcacgggaaggaaattgcaccacaatatcttgtaattcaatgattggttgtttttttaacactttcatactcatgttttaattctccaaatgcgatgcccataaatgtttcggattatcttctgcttgtactaatttcaaatgttgatttggatttgcattaggacgaagagaacgactggcaaatcgatctccttcagcaaaatcaaaaggcgatggtacactgccaggaatttgatacaagcgttccgctctacactcagtagaaagtactgaacccagcaaccctctagtgtattcatgcatcggattcattaataatgaacttgttggagcgacttctactacctgtcctgcatacattactgtaatatgatgagcgatttgtgctactaaggctaaatcatggctaacaaaaaccatagcaaagcccaatttttctcgtaattcattaagtaatttaattacttctgcctgcactgttacatcaagtgcggtagtaggttcatcagcaatcaataatttcggttctctagccaatgccattgcaattaatactcgttgacgttgtccgcccgataattcgtggggatagcgatttaacgttttttcaggctctaatttaacccatcgtaaaagtgtttccgcactttgttttccgccacgctgaatcagttgtgccatttgatctttaattcgcattgatgggtttaacgcacttaaagcatcttgataaatcatagaaatttcgtgaccacgtaaatcatttaatttatctgttttcaataaatcatgttgatttcctgcacgatctgtaaaaagtatttctcctgtaatcttggctgttttaggcaataatcccataatggaaaatgcagaaattgatttaccacagcctgactcgcctaccagccccatagtttcaccttcatgaacagtaaaactaatattatccactagtggaatatcaccataacgatttggaaaacgaatagataaattctttacttgcaaaattggcttcattgctgaattaagttgcattctatcagtacgttccgattctttttgatttaattttaataaataacgtttaagtgctaaactttccgccatagcttcttgtacatcggtagcaagaggctttgatacatcacctttgttatttggattacgtttaagttttggattcacgagagcatcagttagtccttctgacaaaatattaagtgataaaacggtcaacaaaatcattaatccagcaaaggtagtggcccaccaaaagccacttaatactaaatttcgaccttcggataaaacatttccccaagatggataagggggttgtactccggctcctaagaaggaaagagaagcttccaatacaattgcatctgctaccatcactgtagcaaaaaccaaaacaggggcggcagtattgcgaactacatgctttaataaaatatagcttctactgccaccaattactcgctccgctctaatataatcttcttcccactgagaaactacattagctcgtacaacccttgctaactgtggcgtataaactaccgcgatagttaaaataataatcggaacagagttaccaaaagtagccaataataccgcagctaatgcaattcccggaaatgccattaaaatatccattagacgcatgatgacttcattaccaaatttactcgctgtagcagcggttgcacctagtatgctaccaaaaattattgcaaaacctaccgcacctaagccaataaacaatgatgttcttgcaccaaacactaaacgagagaaaatatctcgtcctagacgatctgtgccaaaccaatagtcactatttggtgcttgcaccggtcgtaaggtttgtaatggatcataaggagaaacccaaggtgcaaaaatagcaattaatgcaatcaacatgataaacattaaagcaattttagaggccattgataacgctttgaatcttgctccgccttgagcaagtctttcggctaatccttgacgaaacatcataaactccgaatttttggattgatcacaaggtacaatacatcaacgataatattgaccaatacaaaactaaaggcgattgttagtacaacaccttgtactaaatgcaaatcatgattgacgataccgttaaaaattaattttcccatacctggcaggtcaaaaatttgctcaataactaccgcacctcccagcaaataaccaattcttaaccccaatacagtaacgggggtaatcaacgcatttcgtaatacattatgacgaataacggttgcataaggaacgccattaccaatggctgttcgcacataatctttatccatttcttccaccatcgtagttcgtacaacccgaattagagatgcacacacaggtacagctaaagcgagtgaaggcaaaatcatcgaataaaaataaccgctcggatcttcactaaaagaagtaaatccgccggaaggtaaccaatccagttccagtgcaaaatattgaattaacaaaatcccaagccaaaaagaaggtgttgctacagccgctactgataataaacgaataatttgatcaatccatgtatctcgataaagtgcggcaataacgcctaaggtaaaagaaactattgcagcgaggaatacaccaataaaagttagctgtaaagttagtggaaaggctttcgcaatcaaagaagtaatcggttgttcaggtggtgtggtcataccgaaatttaagtgaattaaatttccgataaaacgaaaatattgcacaattacgggatcatttaaaccgtgctgttctcgataaagttgctttgcagcctcacttgcaccttcccctaatgcgacagtggcaggatcacccggtgtaaattgtaagataataaaaaccaaagcactcacacctaatatcattatgggtaatgccgctaaacgacgaagtaataagcgaaagacaatttccattatttttctccaactatacaaaccaagtcagtagaatgaatctgctatcaataaagataggggctgttaatcataaccacatataaatgaccgcactttctgctcattaaaaacaagcagaaagtgagaaaagttaattatttgcgacctacaccaataaatgaaagtccggtagttggaattggttggaaaccatccagtgatttgttattccaagcggttggtaatttacggtgcaaaattggataaagcggtacttgttcagcaataagattaatagcctgagtccaagccgcttttgcatctgatggctgttttgctttaattgcatcatcaagtaataattgcaatttcgcatattcaggggtatctgaccaaccgaagcgttttttcggccaaacatcaccacgataccaccagctcaataagagatccaaatcgttgctaaatactgatggatcccccggtgccattacgacttcataatttcctttgtctacgtaaccaccatacaatgctccagattgtagatgctgtaaagttactttcacacccggaattttattccaagattctaaaactaaaggggcacattcttttatccaagaatgatctgtagaaagcaattgaaactctaatttattcagacctgcttcttttaaaagtgcggtggctttttcaggattataatcatactgggttgaagccttgacataatcaggatgcgtatcttgagtgtaagaagtggcagcttttgcattacctaagaatacaatatcaattaatttttgtgtatccagtgcatagtgtaaagcttgacgtactttgggattgttaaatggggctttcttacaattaaacattaagaataataacccgaaagattgcacggattcaaccgcacttttacgttttaagcgagatgcgtctaaataaggaacactttccattgcttgagtacgtccagactcttgtgccgctgtgcgagcggcatcatcggatagtaaaaaccatgtcattttttctacacgagcaggatatggaccgttgtaagcattgtgtgcggcaaatacaatgcgatcgtcttttacggctgaaacaaatttatatggtccggatcctaccggatttgcatcaaatgccgtttgtcctacagcctcaatcacatgtttaggtacaatttttacaatacctaatcgcaatttaaaaagagaaaacgggtacttcaacttaaattctaccactttatcatctaaagcgttgactgaatcaataaacggaatgaattgtataaatagtgaagcattttttggatctaaaatacgctgataagaatatactatatcctctgtggtaacaggtgtaccatcgtggaaagtcgcaccgtcacgtaatgtaacacgccatgttatatcatcaacttgttcaggttcttttgcagctaaggcgagataaggttcacgggtggcagggtgtaaatccactaatccttcaaaaaagtgcatgttggcggcaaaggaagaggctccactggaagtggacggatcaaaaccggttgataggggataagctattcctgcttcaatgctactacctgttgttgaagtggccttcgccttagaaacaaaactacctaatgtaccgctaaaggcaattcctgcaccgacaccagccaatactttcatgaaattacggcgagattcattttcaatgtaatttgtcatacatgctccttaaaagtctattttgtacacacttattgagattaatacaacgttccttacacttacacagaatatcattccctaaaatgaagtaaattaatcacaatataaattaaaatgaattggattaatcataatcgtttagagcaaacagtcaagaacatatgtaaagtaaaatctatgtttgtgaactaggtcacgaaataacggaaatctcaatttgattaaagagttaactactatctaaaagcccctgtcagctatagggaaacttgatgaatataaagtggctaattagccactttatatttgcatctgatatttaaacaaatgttttaaagatgacattatccgctttctgaatataactattcatttgatcaaaattcatatagcgataggtatcgtctttatcttgttgcaaattttgaacaaaatctaaatattcagatggggtaggtaatttacctaacaatgcagaaacggctgataattctgccgaggcgagatacacatttgctccttgtcctaaacgatttgggaagtttctagttgatgttgaaactaccgtcgcaccatcggcaacacgagcttggtttcccatacaaagagaacaacccggtacttcaattcttaccccacttttaccataaatgctgtaataaccttcgtcactaagcaacttagcatccattttagtagggggagcaagccatagccttgttggaattgtaccgttaaagcgagctaataatttacctgctgcacggaaatgaccaatattcgtcatgcaagaaccgatgaatacttcatcaattttgtcgccctgaacttcagaaagtaaacgagcatcatcaggatcattcggggcacataaaataggctccttgatttcattgagatcaatttcaataacagccgcatattcggcatctttatccgcctctaatagttgaggattcattaaccaattttccattgctcgaatacggcgttcaagggtacggacgtcaccatagccttcggcaatcatatatttaagtagaacaatattagattgtaaatattcgataataggttctttagcaagtttaatcgtacaagcagctgcggagcgttcagcagaggcatcggacagttcaaatgcttgctctacctttaattgctccaagccttcgatttctaaaatacggcctgaaaaaatgttctttttacctttcttttctacggtaagcaatccttgtttaatcgcataataaggaatggcatgaaccaagtctcgtaatgtaatccctgcttgcatttcacctttaaaacgcactaaaacgctttcaggcatatccaaaggcattactccggttgccgccgcaaaagcgaccagtccggaacctgccgggaaagagataccgattggaaaacgggtatgagaatctccgccggttcctactgtgtcaggtaataacatacgatttaaccatgaatgaataacaccatcgccaggacgtaaagatacgcctcctcgattcataataaaatcgggtaaggtatgatgagtaaccacatcaacaggttttggataggcggcagtatgacagaaagattgcatcactaaatcagccgaaaaacctaaacaagccaaatctttaagctcatctcgggtcataggtcctgtagtatcctgtgagccaacggaagtcattcgaggttcacaatattgtccgggacgaataccctctacaccgcaagctcgccccaccattttttgtgccaaagtgaaacctttttgattttgcaccgcactttgtggtttggcaaaaacatcgctttcaggcaatcctaatgcaactcttgctttgtgagttaagcctcgcccgataatcaatggaatacgtccaccggcacgaacttcgtctaataacacattagtttttaagctaaattcagctaaaatatcattactgtcatgacgacaaattttgccttcataaggataaacatcgatgacatcgcccatatttaaacggctgacatctacttcaattggcaatgatccggcatcttctagcgtattaaagaaaataggtgcaatttttccccctaacaccacaccgccggcacgtttattcggaatataaggaatatcttcccccataaaccataaaactgagttagtcgcagatttacgtgaagacccagttcccacaacatcgcctacataaaccaacggaaagcctttttgtttcagtgtttctaattgtttgattggaccaatattaccattatcatccggtttaataccttctcgggcattttttaacatagcaagagcatgtaatggaatatcaggacgagaccaagcgtcttgtgctggcgaaagatcatcagtattagtttcaccgctcaccttaaatacggttaaggttaatttttctgcaagttgagggcgagataaaaaccattcagcattagcccaagattgcaaaatctgttgtgcaaaaacgttaccgttttctgctcgttgtgcgacatcatgaaaattatcaaacatcagcaaagtagaagacaacgctttcactgctataggtgctaattcaggattatcaagtgcggtcaataatggctcaatattgtaaccaccttgcatagttcccaaaatttctactgctttgcttggtgaaattaatttacaagttaccgcactttgtgccagtgcggctaaaaaaccggctttaacataagcagcttcatcaacaccggcaggaatacgattctcaaataaatcaagtaggaaatcctcttttcctgtcgggggatttttcaataattcaattaattgagctgtttgctctgcatctaaaggtttagggacgacgccttgtttagctcgttcatcgacatgtttttggtaagtttgtaggaaatcgcacattattcactccattaagattgttgagtagagaaaagagaaagtgcggtcatttttgttaaaaaattgtaatacaaatagaccgaattcatcataatacggaatttatagatgaacaatagaaaaaagacgattattaaaaaataaccgccttttttaaagtagaacacaaaatgtttaaaagacttttttaaatggtttaatgatgactttatcatatacaccggctgcaacataaggatctgtatttgcccattgctccgcttcttctaagctattgaattttgcaataacagttgaaccggtaaaacctgcttctccaggattttcatcatctatagcaggattaggtcccgcagttaataacctatcttcagcttgtaattgttttaaacgttcaaggtgttgttctctgacggataagcgtaatgctaatgtatcaggtttatcttgagcaaaaataacatagtacatcatggtttatttctcctatttattatgagttatttgctgaaatttgtgccaatgctttttctacttccggattattgtctcttggtatggctcgaggtttaccttgtgcatctacggcaacaaaagtgaaaacagcttccgttacacaatagcgttcaccaataggttcgctggcaacctttttgacccatacttcaattttgatttgaacggaagagcggccaatttttacacattccccataacagcaaaccacatcgccgacagcaataggtttgataaatgtcatactgtttacagctactgttacaacacgtccatgagcaatttctttagctaaaatggcacctcctatatccatttttgacataatccaaccgccgaaaatatcgccattcgcattcgtatttgaaggcatagctaaggtacgtaataagagaactcccttcgattgacgacctgtattagtttcaataaatactgacatagattttccttattcttgttctgatttaggtaaataacgataaatataaacaccggttactaatgttgcaatcagtgtcatgccgagaatgccgaaggttttaaaatccacccagatgtcatcagaaagatactggcttatgtaaagattaatcagcatacaaagtaagaaaaagactgcccaacctaaattgaggttatgccaaacataagtgggaagctgaatttctttgcctaataattgttggattaaaggttttttaaaaccatattggctgacaagcaaaatcaaggaaaaaagggcataaacaacggtaaccttccattttaaaaattccaattcattaaaataggcacttagagaaccgaaaaaaactaccgcacttcccataataagttgctgtttctcaatttttccatatttaagttttaaaatcatgagttgaattaacgttgcaataatcagcgtaatggcagcagcttgaataccttgtaatttgtaaacagcaaagaataagatcaatgggataaattctaatagttgtttcattattgtcccctttgttgcataaagagagtgtaaaaacggtaagtgaaaattaatagaaatacgtctgcaagggaaattattgcagtgattaagatttccataaacagattatgactgagaaatagcgaaagctgtcttaataaaaaaggcaataggcaattgattaaagtatataagaataacaggtgtgtgcgttttactccgcttttccacattgtttttaaactttgactaatggagtgattatgtatgaggtaatggacattgagtaaattaagacgcacaaacacaaatatacctaatgcgagtgcaaataaagaaaagatagaaggtgatttgtgcatgagagctgaaactagaatttcacttgtaccgatacccaaaggaatagctattaatatattgagtaacaaaagccctccgaaacgtttagttgtcgatataacgctttgagatagttgcggttcgatatgttgactgagttggtgaatggttaatattccccaagcagaaataaacattctcaataaacccgatatgaacaggtaatgactgagttgcaaagtttccgtatttgatattgtttctgatagctcaagcgtgtctgtttgtattgactgtttaaaaaataaagcaaatacagaaacaataaataaaagagcggtaaattgtagcgtgattttttgttgattgcgtacaaagttccaacaatcttgaaatatatgagtaaaattaatcattcaaaaatccataaataaaagcaaacgttacgcattatactgtgtttacagccgaaagtataaaaatccttattacagaccttaagcatactaaagaggagatttaaacttttagtaagctgattgtaacgattttaaaaaaatttttaacaaaattttataaatttgatctagttcacggaaataatacctcttaagtggtattgtacccgccgattgcataaatcggcaatttttattgtgagcaaatattctaatagatgaggaattttctatgaaaaaaacagcattagtacttagcgtggcggctgcattggtggcaggaagtgcaacagcacatgaagcaggcagttttattgttcggggtggtcctattttagttgtgccgaaaacatcaacaaatgatgatatgtttaagtttgatgtaaacaaaaatgcccaattggggttgaccggaacctatatgatgacagataacttcggggttgagttattagccgcaacaccgtttcatcataaaatcacgttagaattacattaggtagtgccttagtaggtaaaacaaaacatttaccgccaagcctatatttacaatattatttcttaaacaaagattctaaagcacgtccttatattggtgccggtgtgaactatactaaattctttggtgaaaaagcgataatggagggtgtttccaatcttaaattaaaagattcttggggagcagtatttaacgcaggggtagatattcaattgtccgataatctttatttaaataccgctgtttggtatgcgaaaattaaaacaaaagcaagttttaaaatgaatggtgctgttcaacaacctcaacagaataaagtcgatgtaacccttgacccaatggtatttttcatcggtttaggttggaaattctaagcagagaaaaatattgttgaaggcatgaccaaaaggtgatgcctttatttttttctcaaaatgaccgcacttttatggaaatagcgtataaagtaaaaattaatgttttctctttacatgattttcgttaaaattcggcattcgtccatttttagttattacaacaataatgatcaagcaagctcaattttatattctttctcaacaacaaggaaaaaacggactttttgcggaagaaagtcttacttgcgatcttgccgcctccgcttggcggttggggaaaaaagtattaattacttgtgaaacggaagagcaggcattaaaacttgatgaagctttatggcaaagagatcctgatgaatttgtaccgcataatttatccggtgaaatgacttcatacgtaacgccgatagagatttcttggcaagggaaacgtaatacacaacgacgggatatactgattaatctgcaatctcaattacctgattttattatgagttttaatcagctaattgattttgtgccggttgatgagcagttaaaaattcttgcgagagaacgctataaatcgcttcgttcgcaaggttggcaattacaaacagaaaatatgtaaatttttataaggagtttttttatgaaatctaaaattttggctaccacactcgttggattgctattcggattggttgcttgtgaaaaatcacaagaaagcgtatcaaccgaaaaactggataacaagcagacggagcaagttgaacaaaaacaactggaaagtgcggtggaaaacagcactgaaacacctgtgcaacatgttcaaactgataagatgtcagaaggaatgaaatcaacaaccgaagaagctagcactgattcagcaataaaccaagaaaaattagctgaaaataaagctaaacaggttgaagctaaaaaagtagcggaaaaaaatgaaaccaaaaaagttattgcgattttagaaaaacaataccaaagccttcattgcaccgatggaaataaaagcgaattttgtgtagaagaagcacaacgcttaaaaagtgaaattgaacgactaaaatctcaattgcgtaaatagaaagatgagtagtcgttagatttaagacatctacgctagataatctcttctctctaggcggtaagttagaaaaataacaagccgtagaatggctaatttatgcccagcttcacacggtttctatggggaaagagcggttagattttcgggaaattttgcaaaaatgaatcgtaaattaatccaaatcgatcagctaaaaaatcagcttacacaatatcgtccgctttctgaatccgaagtaaagcgtctgcgagaagaatttattattgaaagctcatataattccaatgcgattgaaggcaataccattaccctgcgtgaaacagtgctgattttaaaagagggaatgacgattgcggaaaagccattacgagaacatttggatattatcggtttcaaagatgcctttaactatatttatgaattagttgccaataatgaaccattaagcgagcgaaccattaaagatattcattcgcttgttttaatgaataatgccgaaagccgaggcgtttatcgtaaaattccggtgcgtattttaggggcggaaaacgaaccgacagctccttatttaattgctgaagaaatgcagtcattgattgaaaaatatcaacaaaaactgaccgcactttaccccatagaagcaattagttggttgcatttagcctttgaaagtattcacccgtttattgacggcaacggacgaacagggcgattactgattaattttgaattattgaaacacggctatttgcctgttgatattaaatttactcatcgagcaaactattaccaatgttttgatgatttccataaaaaccagcaggatattagcagtttggttgagttgattagtcagtatgaagtggctgagttgaacaggtatttggcgattttggagcataggacataaaatgacaagccgtgaagaattactcaaaaaacaacgtgagctggatattctttttaccgcttggtttgaagaaaagaaaaagtacgaagtgctgacttatcgtcgtgaaaatggggatttgattcagcattatccggacggtacagagaaagtgatcaaatatgctgaaaaaactagcactgctcgtatggcgtaacaagcggttggatttaggcaaaattttgcaatgctttaatcggagggaattgtgatgactaaaccggtaaatgcggaatatatcaaagaaattattgataaaacgaataatcttggctatttggacatccaaggaaaaaccttgcaagaaaaacaagagagttttaaatctttaattcaggaaaaattaaagggatatcacaatgacagtcgaaaagatcattatcaccgaagctaaggttcacgagctttttgttgaaatcagtcaagaattggggtttagtgatgaagatattttacatcattctcaaaacattcttgaattgattgaaatgtggtcagagcaaaaatttgtcgaaatttatcaagaaaatacggatagagtttttggtcgggcaaaagatagtagtcttgcaccaggtgcggttccctattatttaggtatttatcacgccagagtagataaacaaggtgaaaatgatccgttaatcgttttaacatttagatcagaaagagaagataacatcgctgaaattcgctttatggcaacacacgatattttatttggcactgtttccgataaattatttatgcaacgaatgaaagctattcgtcaaagaattgatcttttagtccaaaaagggaattaatttataagggctacacggctacgcatcagcccacacggctcgtgtggggtgacaagcggttaggtttaagaaaaattttgcaaaaaacttctcaaaacagaccgcttgtaaaataacaaggcatttgtctagagaggagtaccatctggaaaataatcaaatatgcagataaaaaataacttaaagtttatggacttctgctcaggtattggcggaggtcgtttagggctagaactaaacggaatggaatgtattgctcacagtgaacttgatcctaaccctgatttaacttatcagctcttttttaatgataaaaataattatggggatttaaccaaaataaatatcaacgatttacctgaatttgatgtaatgcttgcaggtttcccttgccaaactttttcaattgtaggaaaacgcaagggttttgaagatgagcgtggacagattatttatggattagtcgatattttagccgttaaaaagattccttatttcattttggaaaatgtaaaagggttggttaatcataataaaggagaaaccataaactctattgttaagctgctagaagaaacgggctatgatgtttattatcaggtattagatagtcaattttatggtgtaccacaaatgcgtgagagggtttattttgtgggtattagaaaagatattaaacacaaaccttatcaatttcctgaaatggaagatgccaaacctatttcttattatttaagtgatgaccgtgattatacctttgatgagaacaatgaaactttccagaagtatttgaataataaatataatcaagggcaaaataaccttactgaaattttgcaaacggattataacgtgattgattggcggcaatctgatttccgactttatcctgaaaaaagcccgacattgagaaccggacgacacggtattttatataccaaaaatggtaaattgagaaaattaagtggttatgaagcattactattacagggatttccaaaagaaattgcacaaaaagttatcgagcataaattacctgacagtaaagttttatcccaagctggaaatgcaatgacggtgacggttattcagaaattagcggctcaattattaaaatcgatagaaagcatatagagaggtgaagatggatttagccaacctaggctcacaaactgcaaaaaatggctttaagaatgaaaaagatattgctgatcgttttaatcattggcaatcacattctgaagctcaagactggttaagaataatgggttatgaattagataaaattgaaaaggttaaagctgttgtattaagtggttataaagcagatattaatgttcaagtatttatcttttttaaagaagctgttgatgttcgtaacattcaagtaaaattagttagtaataaacgaggctttaatcaaatagataaacgctggttaaaaaattatcatgagatgtggcaattcccagcagaaatttaccgcttgttacagcatttttgtggagaactacccccggttattgagaacccaaaagataagcgaagaatgtttatcacagaatttagtgaacaagaacaacgtttaattttagattggttcaagcagagtaaaattttagttttaactgatattattcgtggtcgaggagatttttcagcagaatgggtattagttgcccaaaaaattaacgataacgctcgttggattttgaaaaatattaatgaggttctacaacattatggtagtggcgaaattaagatttctcgacaaggttcaattaaatttggtcgggttactattcaacgtaaaggtggagatcgtggcagacaaacagccaatatgttgcaatttaaaatagatccaaccgaattatttgagatttgatttcaagctgcccccaaatgcaaaaattaacataagagaaaaaccaatgacaaaacaattcacaatggaagatcgtttcaacccttccgccgtagagcaagcactctaccaacactgggaatcgcaaggctattttaagccgaatgaaaacccgaatgttccaagttactgcatcgctattccgccaccgaatgtaacggggagtttgcatatgggacacgctttccagcagacgttgatggatactttaatccgcttcaaccgtatggagggcaacaacaccctttggcaggcgggcaccgaccacgccgggattgcgacccaaatggtggtggagcgtaaaatcgcagcggaagagggcaaaacccgtcacgattatgggcgtgaagcctttatcaacaaaatttgggattggaaagcctattcgggcggtaccatcagccagcaaatgagacgctttggtaactcaatcgactgggatcgtgagcgttttacgatggacgagggcttgtctaatgcggtgaaagaggtctttgtgcgtttgcacgaagaaggcttgatttaccgtggtaaacgcttggtgaattgggatccgaaactgcacactgccatttccgatcttgaagtcgaaaacaaagagagcaaaggctcgctttggcacttccgctatccgcttgctaacggtgcgaaaaccgctgagggcttagattatttagtggtggcgaccactcgtcctgaaacgatgctgggggatacggcggtggctgtgcatccggaagatgagcgttatcaatcgctgattggcaaaacggtcgtgctaccacttgccaaccgtgaaattccgattattgctgatgaatatgtggatcgtgagttcggtacgggtgtggtgaaaattacccctgcccacgatttcaacgattacgaagtgggcaaacgccacggcttgccgatggtaaatgtgatgacgctcaatgccgatattcgtgcggaagcggaaatcattggcacagacggcaaaccgcttgccggctacgatgccccaattccagccgactatcaaggcttagagcgttttgcggcacgtaagaaaattgtggcggactttgactcgcttggtttattagaagaaatcaaaccgcatgatttaaaagtgccttatggtgaccgtggtggcgtgccgattgagccgatgctgaccgatcaatggtatgtgagcgtcaaaccgcttgccgaagtcgccaccaaagcggtggaaaacggcgaaatccaattcgtacctaaacagtatgaaaatctttacttctcttggatgcgtgatattcaagattggtgtatttctcgtcaactttggtggggacatcgtattccggcttggtatgatgaacaaggcaacgtttatgttgctcgagatgaggcggaagtgcggtcaaaatacggcttaacttcagacgtagcgttaaaacaagatgaagacgtattagacacttggttttcgtccggattatggacattctcaacacttggctggcctgagcaaaccaaagaactgaaaatgtttcacccgaccgatgtattaatcaccggttttgacatcatcttcttttgggtagcaagaatgattatgttcacgatgcacttcatcaaagatgaaaacggcaaaccgcaagtaccgtttaaaaccgtttatgtaacaggtttaattcgtgatgaacaagggcaaaaaatgtcgaaatcaaaagggaacgtgttagacccgattgatatgattgatggtatcagtcttgaggatttgcttgaaaaacgcaccggcaatatgatgcaaccacaattggcggaaaaaattgctaaagcaactcgtaaagaatttgaacatggcatttctgcacatggaacggatgcgttacgctttaccctggcggcgttagcgagcaatggacgtgatatcaattgggatatgaaacgtttggagggctaccgcaatttctgtaataaattatggaatgctagtcgttatgtattaacccacgaaaaagtggatctaagtgagggcgaagcggaatattcgttggcggatcgttggattgagagtcaattcaaccgcactatagacgcatttcgcaccgcacttaagcaataccgtttcgatttagtggcaaatacgatttacgattttacttggaatcagttctgcgattggtatttagagctaaccaagcctgtatttgctcatggtacggatgctcaaaaacgtggtacaagtcgcatgcttcttaatatattagagaaattattgcgtttagcacatccaattattccatttatcacggaagaaatttggcagaaattgaagggtgtaatgaagttatcaggcgataccattatgttacagccatttccacacgcagaggaaaatcggcttgatctagaggcggaaagccaaatgaattggttaaaagaagtgattgtagcggtgcgtaatattcgtgcggaatgtaatatttcaccgagtcatatgttggaactgttgctgagaaacatttcagaggaaacaaaaatttgtcttgaaaataaccgcactttattacaatctatggcaaaattgtccacgattactttactggacgccaatgaagaaccgccactttcggtcacgaaactggttgaaaataatgaaatttttattccaatggcaggttttattaataaagagcaagaactcacaagattgactaaagaaattgaaaaattgaaaggtgaaattgttcgaattgaaaacaaactcagcaatgaagcctttattaccaaagcaccggagcaagttatcgccaaagagcgggaaaaaatgcaggggtatttggataatatagaaaaacttcaacaacaatatcaggcgattgagatgttgtaagtatttaggtcgatatttgatctcccgccgtcaaatggcggtcgggagatcgatgttaatcgtggtgaaaatctatcttaggttctcccaagaataacggaccgagtggatttttaggcaaattgaagtgattaggatacttcacctctaccaaatataaaccatcaggtttagcagttggtgcggctaaagtgcggtctttttgagttaaaagccaatccatccattcaaccggctgttttccgcttccaatttctaaaagactgccgacaatattgcgtaccatatgatgcacaaaagcgttagcctgaatatccacaataatgtaattggcttggcgaaaaacatggagatgatgaatatttcgccatggtgtattagactggcattgtgcggcacgaaatgaagaaaaatcatgttcccctaataaatactgccctgcttggtgcattaaatgatgatccaatgcaacgtgatgatgagtaactccagtgggaaaaagagcggaacgtagtggatgattataaattaaataacgataacgccttgctgtggcactgaaacgagcatgaaaatcctcgctgacgacctttgcccaacgtaccgcaatatcagcaggtaaattggcattaagaccgaatgtccatgctttttcagagcgaatcgctttcgtgtcaaaatgtaccacttgaccggtagcatgaacacccgaatccgttctacccgcacaatatatttgacaaaattcatttgcaacaaaactgaccgcactttccagtttttcctgtacacttgtgacattcgcttgacgttgccaaccgaaataatgtgtaccgttatattcaatacctaatgctattttcatattattttatctgttaagctgaaacccattttatgatacttgaatatagtcgagcggtatatcacctaaatacgccaatagttcttctgtcataccacgatatgacaacctgaaaggttgttcaaccaataccgctcgagcaatattttccacctcatttccatttaaaagtaaataattcaatgctgtttgtagtggtggtaaagagggattaaatgcggcattttcagcataactgccttgaaaaatctgttgatcttgcaattgcaatgcaatacctgaataggttttggaataaggagcatgagattgattggcagcatcaagtgcggcttgaattaacggatcttccgttacaaaaaacaaattatgtgcttttttatcaaatagacgattgtctatctgtaaattgtggggtccaaaagcatccggcaaatagtgatgtaataaattatcctgactatgtggcaaatgaatgcgtaatgtttccgcactgttaagttcattcataaattggcgacaatgtccacaaggtgtgtaattgacggtaatctccgttattttactttcacgacgcatccaagcatgagaaattgcactttgctccgcatgaacggtttgctgaatgttcgtggtacaaaattcttgattagcaccaaaataaaagctgcctgactctcctttagcaattgcccccacactgaaatgggagattgtgggattagcataacacgcactgacgggtaataacattaaagccaattctttgtccgtcatatgatatttttcgcaaaaatggtttactgtgaatgcgggtagaaagccctgaaaattctgttcgcctaagatataccacagatcctgagccaaatttctgttttcaatttgatttaaagcctgtttaatccgatcagatatatgttttaatgaatgatgtgtcatcataaatccttgttgaatattgagattgggttgaatgtgccaaacatttaaaataacgtcaagtagatgttttaattgtatcttattatttttggctgaaaaatttccaattataacaagttaaacacttttaatatttcatcaaaaatataattttctgcattgaaatagttactcttttttaaacgacatagcataactcgccataaaattggatctttaatttttacgctgactaaatgaggatcgggataatagtacgctgtagataggggtagaatagtcaaaatatctgaattagattttgcagtgtaatataaaaaatcccaacaggctgattcatagatgatattagggtaaatattatgtcgttcagatgcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttctggagagcaaaataccgagagttctgagcgataaatttcgaaagattcaataatcttagatgaaatatgttcaggatagagcaaggttgcaaaattgacattacctaataatagttcaccttttaatgaatatgcaccttgttcttttacttcaaattcaatttgaggattatttataatcagttccggcaaaattttagaaaaaatcaaagataaaattaaaggtggaataccgatagatattcgccctgtcatttcttgttctttcttatgtagatttttgttcatttgattgtatttcttgagtaattctttagcatcacggtagtagttttctccaacgtaagttaaccctctaatttttccattagctcgtgtaaataatgcaatattttcttgatgctcaaattcattaatcatcatacttaatgccggttgagaaatataaagattttgagatgtccgacttaaattgaagccgttttctacaattccaataaaataacgtaaatgtttgatatccatgatttctccttaaccaattttgtgttcagccgttctataagctgtgtttcttttgtattctttatatgtatctacattctataagattaatttataggtatgtaaaaaaactgtattttgaattattcgaacaaattactacacttacctcaaataaggtaagaatactagattatctagattttataagtatgcttgcttagtttttttgagatgtattgagcgttttactctctcaatgtataacaaaaatttaaccttaaatataaatttattttatctcataggaagatgctatgtctaaatttatttcaattgatgagctcaaatctcatttttttgatggaatgacaatgatgtccggtggtttcatggggtgcggtgctcccgaactcatcattaaagaaatcttagaggcaaacattaaggacattactctaatcagtacggacaccgcaatggtagatactggggtaggtcctttaattgttaatgggagaataaaaaaactatatgcctcacatatcggaacaaattctgaaactggtaagaaaatgatttccggtgaattaaatgttgaactttgtccacaaggtactttagcagagcgtattcgtgcaggcggatcaggattaggcggatttttaacgccgacaggggttggcacagtggtagaaaaaggtaaacagaaaatcactattgatggtgtggaatatttactggaactaccgttaaaagcagatattgcaattattaaagcggatattgccgatgagattggtaacttagtttttttaggtgcggctcgtaattttaatccaatcatggctctcgctgccaaaacagtcattgtacaagcaacaaaaatcgtgaaagtaggtgaaatggatccaaatttagtgatgacccccgcagcagtggttgattatattgtaaaagcgtaacggaaggagaaaaaacaatgaatgctaaagaaattattgctcgccgtattgccttagaattaaaagatggtgatgttgttaatcttggtattggtttgccaactatggtagcaaattatatcccaagcgatatttcaatcactctacagtctgaaaatggctttttaggtttgaccgcttttgatcctgaaaatcccgatgaaaatattgtgaatgccggtggtcaactttgctcaatccaagcaggaggtatgttctttgatagtgcttattcatttgctttgattcgtggcagtcacgttgatgcttgtgtactgggcggtttagaggtcgatcaagaggcaaacctagcaaactggatggtgccaggaaaaatggtacctggcatgggaggggcaatggatctagttactggtgctcgtagagtaattataggtatggagcattgtgcaaagacgggaacctcaaaaatattaaaaaaatgtactttaccgctaactgcacgtaataaagtccatctagtcgtgactgagctagccgtatttgaatttatcaatggacaattaaccttaactgaaatggcggaaggttatgatttggatatgattaaagctaaaactgaagctgaatttgtcgtttcgccaaatctaaaaacaatgtcgttggcaggtgcataaggagcttattatgattagccgtatttctcggtttatgacaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaaataaggaagcaactatgaaaaatgtcgttattgccagtgcggtgcgtaccgcaattggaaattttggcggttcacttgcagacacctctgctgtggaactcggtacagcggtaatcaaatctgcgattgaacgagcaggtattgatataactgctattgatgaagtaattatgggaaatgttttacaggcaggtcttggacaaaatcctgctcgtcaggcactattatgttccggcattgctcaagatgtaccagcttatactgtcaataaagtctgcggttcaggcttaaaagcagtagttctaggcactcaagcaattaaagctggtgatgctaaggttatcatcgcaggtggtatggaaaacatgagccaagcaccttatcttcttgaatccaaatctcgttggggctaccgattaggagatgcaaaagtacaagatgtgattttatctgatggtttgatttgtgctacaaaccactatcatatgggtatcacggctgaaaatatcgctaaaaaatatgatattacccgccaaatgcaagatgaattagcacttgcctctcaacaaaaagccaccgctgcgattcaatccggtgcattcaaaaatgaaattgtaccgttaaatatcaaaattaaacgcaaagaggtcattttcgacactgatgaatttgtcaaacaagattcaaccgctgaaggtttagcaaggcttcgtgccgcatttgataaagagggtagtgtaactgccggtaatgcgtcaggtattaacgatggtgcggcggcattagttattgttgaagaagaaacggcaaaagcattagggttgaatattcttgctcgtatcaaaggttatgcaagtggtggcgtatcaccagatattatgggaataggacctgttcctgctactttaaatgctttgaaaaaaacaggtttgcagttaagcgatatagacttaatcgaagctaatgaagcttttgcggcacaatttttagctgtaggtaaagagttaggggttaatcccgaaaaagttaatgtcaatggtggagctattgctcttggtcatccaataggtgcaagcggagcacgtattctagtcactcttttacacgcaatgcatgctcgtgataagcaattgggtttggcaactttatgtattggtggtggtcaaggcattgcaatgattgtggaacgtatttaataccaactggaaaaaaaggaaaatattatggttaaaaaagtggctttaattacaggtgcagcaagtggtattggtttggcaatatgtgagagccttgcaaccgaagatttaaatatagtgatggtggatgtaaataaagagacattaaaagaacattccactcgtttaggaacggcttatattcaagcagatctttcgaaacgtgaaggttgtaaaactgcggtagattttgcagccgaaaaatttggtagcgtagatattttggtaaatgtagcaggtatccaaaatgtagccgccattgaaaatttttccgaagataaatgggattttatgattaacttaatgcttactgcaccatttttgcttactaaatacagttggaaatacatgaaagcaaataaatggggacgtatcattaatttgaattcaatccacggtttagttgcatctgatttcaaatctgcgtatgtttcagcaaaacacggtttatcgggcttaactaaagtagctgcattggagggtggtgaatttggtattactgttaattctatctgtcctgcttatgttcgtacaccgttggttgataaacagatcgtagatcaagctcgtaatcatggaatttccgaagatgaagttattagcaaaatcatgctttctaaagctgctgttaaacgcatgattgaaccttcagaactcggcgaatttgtcaaatttctctgttctgattcagcagcatcaatctctggatcttgcttaacaatggatggtggttggactgctgcctaaaaatttatggaactggggaaattaatggaaataatcccccgagtttctctttaacttaagaggaaatatcatgagtactatcgcaattattttttcattattgatgctgatgtacttcgcatacagaggtatgacagttttattattagctcccttactggctgcttttgctgtcttactaagcggtgatggatcaatgatgatgccaaaatatacagaaacttttatgtttgcattaagtggctatttacttaattttttccctgtgtttctatttggtgctttattcggtcagttaatggcagattctggtgctgcaacaggtattgccaaaggcattgttaaaatgttaggaagtcggcaggcaattctcacagtgatcatcgcttgcggtcttttaacttatggaggcgtgtctctttttgtagtagcatttgcgatctatccgatttcaaaagtgctatttcgtgaagcgaatattcctaaacgtttgattccggcaacgattgccctaggttcatttactttctcaatgacggcattaccggggacaccggctgcaaccaacgcaattccaattcctttttttaatactaacgcatttgccgctccgggattgggtttaattggtgccatgatcatgttgataggtggttggttatggttacaaagtcgtgctaaaaaagcagcttctttaggtgagggttatggtaaacacgatagtgaatcaagtgcggatttagctatattcgagaaaaatgtaatgccatttagtttatcactacttcccttagttcttgttatcgccatgaatgcaatttttacttatactttttccaatatggactttagctcattgcaagaggtctttccaaatctcaacattaaaggcaagactggattatgggcaatcatcgcctcattattaattgcatgtgtagtattagtatttttacgtcttggtaaatggacatcattacaagaaactatcaataaaggtgtatatggttcaatgttacctatttttaatacggcttcagaagtaggttatggagcagtagttgcttcattagccggattcgctattattcgagactcagtgctaaatgtatcaactaatccattaatttctgaggctgttgcaatgagtgtgcttgctggtattacaggctcatcatcaggaggattaagtattgcaatgagaacgcttggagcagactacctacgtatgggaattgaggcaggtattgatccggatttattgcatcgagtagcagtaatggcagcaggtggatttgatactttacctcattgcggtgcaataattactttactttctatctgtcacttgaatcataagcaatcttacttgaatattgcggctgttaccattgcaataccaatagtagccgtcattagtgtgattgcattaggcacagtgtttggttcattttaagtacaaataagtcgaaaaatggaaagcttatcctgcaagtagttaaattttaaaaatttcttataggaaatgtagcaaaaacagaaagtgaaatacttatggaactgttacacgatatcaacaaaattaacccacttaaaaaagtgggttaaatttaataaaaaggtttatttcaagcaactaaaatagctatctgcggtatattgtaagaaattggcataggaatttttacctaatttaactttgtcacccatcggatccaagcgtccaacgtttacacctgttgctttacctaaactttcaattacttttggtgtaaattgcggttctgcgaataagcaatttactttatgctcagtaatttcttccttaattttagctaatgtttttgcccccggtgcaactaatggattaatagtgaaatagcctacttgatttaatccataagcgttattgaaatagctgtaagcatcatggaaaacataaaatcctttttcttttactgaagctaattgctttttaatttcgttattttttgctgctaaagtgcggttaaattcagcaagatttttttcaatcaatgcttttttggccggatattgtattgacaatttctctgctactttttgtgcaacaattttgctaatttccggtgagtaccaaacatgccaattaatgcccaattcatcatgttcatgattgtgtccatgcttgtgttcatggtcatgtttgtggtcgtgatcatgatcgtggtcgtggtcatggtcatggtcatgatcgtgktcgtggtcatgtttgtggtcgtgatcatgrtcgtggtcgtggtcatggtcatggtcgtggtcgtggtcatggtcrtggtcatggtcrtgrtcrtggtcgtggtcatggtcgtggtcatggtcgtggtcatggtcgtggtcatggtcgtgatcatggtcgtgatcatggtcgtggtcatggtcgtgatcatgatgatggcctgtcattaaaagtcctttagtattaatttctgaaatttcagcaatggtaactacttttttcggatctataccacgtaaagttgcatgatctaaaaacgcatccacatcttcgccaatccaaacaactaaatctgctttttttagtttttgaatatcggaagggcggaaactatagtcatgcggagaagcacctggtggaacaataacttgggtatcagttacaccatcagcaatagatgaagcgataaaacctaaaggtttaattgatgttactatgctagcatttgccacagcagataaagaaaaaagtgctgtactaattaatgcttttttaaaggtaagattagacattggaatactccttttcatgattaataacgattttaaaagacggactaggttatcactttttcatcaaattactagaatttttacaaaactttttagcctttggctaatttatttattatttttgctactgcaaaaaagccaaaagtcgctgttatcattgttgctgcaccaaagccattggcacaattcatggtagctgaaatagtacaattatcagccatttttggaaaaattaaaggctgagtggaaaagacacaatcgactgcaaacttacgtttaggattttgcggaaaatgatattctttacgtaaaactgaccgcacttttgctagtaaggggtcttgaatagagcgactaagatctgctactcgaatttgacttggatcggtttgccctcctgcaccaccaattgtgataatcggaattttattgcgtttacagtgagcaattagtgctgcttttactctgacattgtcaatagcatcaatcacataatcgtagcctgtatgaatatattcagctaaattttcagcaagtaaaaaatcatcaataatattcacgtggcaatccggattaattaattgcacacgttctttcatcacttctgtttttaacttgccgatattacctgttagagcgggtaattgtcggttaatattagttacacagatgtcatccatatcaatcatggtaatttgcccaataccgcaacgtgcaattgcttcgacaacccatgaacctaccccaccaatgccaatcacacaaatatgtgtttgctttaagcgttccaaaacgtctattccatatagtcgtccaattccaccaaagcgttgttcataattatcaatacgttctgtcattattgtaataaccacactctaccatagtgcttcgataaacccgcaatatgtccggcattatcgccaattccacgatataaatcaaaatgctgcccttttactgctcccccaacatctaatgccaccattaaatgtaaaatatgttcaccggtccaattgccttcatcatcaattttcggtacttccactaaaactacagagccgcttgggatcacatttttatcgctagcaatagcagccataggtactaaaggcacaccggcagaaccaagcacttttccgttaggatcttttttgaaaaaaacataagaaggattacgttctaacaaggcttgtaagcgtgatggattttccattgcccaatttttaatggcttgaatagacattttttctttggaaatttcgccatcctctaccagcaatcgtcctattgctacataatcaaaaccattttgtcctgcataggcaaaataggtcaaatctccgtgaccaaaatcaacataaccgctaccttgtacgccaagtagaaaattatcaatcattgaatcagtgtaagccagctcaagtcccttaccttgcaaggcaccggaataaatttgagctcgagaaaaacgtttattagcaggcaaagcataaataggttgattatatttgccctgttgcgtatgacgagcatgaataaccggcgaataatatcctgtcattaatacattttggtatccgtcggttcctttcataatttgagcttgaataccatagtctgctaattgtttagtattcgcacccgccaatacccaatgagttactttgtcataaatgttcgcaaattgattagctaagccagttgatgcttgacgaatattagtaagttgcgttaaaaaatcaccttgattgatgaccgcacttttgttgtcaacagaggaaaccggcactaatgacgcttgctgataactacgcccagcatattttgccccgaattgtttcgcatcattttggctagctgttttagagtgttcggaagaacatgcaaccaaaatagcgaccgaaaataaaatactttgtttaactactgttttgataaaaaataccatatgttaccgaaaaaccgcataattagagacgtcttaaattagcaaaaaaactgtggaatatacagtcttttatcattcaatgaagataaaaaatttacaattcgcttcattttatcattggttgttttgttatttacactgatgcaaaatgtttttacgcttgaaccgtcaaataaaagcgcggtgttaatttagactactttgagtattgcaacgtcagggcttgattttgcagtccaagccctcaaaattatttaaaactcaccgcacttttaggcttcattaattccccaaagccaagccgccccacgcacaccactggaatcgccgtgtacggcttttttgatttcagtaaaaaattctctaccgaaaatataatcgttcatccgtgtcggtaaggttgtgtacagacgatcaatgttacaaacaccgcccgccagtacaatcacatcaggatctaaaatatttacataagctgctagagcttttgccaaacggcgttcataagcttgtaaagattgttcggcagtaggatcgccttgctcggcaagtgcggcaatttcgttgccttttaatcttatcccactccgacgttcgtaatcatcacatagaccggtaccggaaacaaattgttcgatacaacgatgtttgccacaataacattgtacgttatgcgaacgttcttcttcatcttgccaaggtaattcgttgtgtccccattcaccgccgataccgttagccccattccaaggttttccgtcaatcacgataccggaaccgcaacctgttccgagaataagtgccaatacgaccttttttcctgctcctgcaccatctgtggcttcagagacggtcatgcagttggcatcattggcaattcttatttctcgtcctaaaagtgcggtcaagtcttcgtataaattttgtccgttaagccaaacagaattagcatttttgacttttccggtaaaaggggaaatagtgccgggaattccgatccctactgtgcctcgttgccccgttgcatgttccgcatcatctaccaaacttttaattgctgtcaacgtgtccggatacgaccctcttggggtaggaatacgtttgcgaaacaactcttcaccgctgttacttaacgcaataacttcaatcttggttccacctaaatcaatacctatacgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtacagttgaaagtttttctattttaaccgcactgagtttcagcataaatacagttattgactaaattttatgttatacatcgtaaatatttctaatcagactcacaaagaatttagaaaatcttgttttatttttgtgatcttcatcacgattttatggtgtgaatttataaattgtgataaatatcacatttttatcactgattaaataataaaaaatgtgtcctacatcacaaatcttaaagaaaaaatttttgtttttattataaatatgttattttttctgcctgaaaaatagccaattatttctctttacgtgttctatttattgaggttaagttatgctatcagcaaatgcaaaagtcaaaatccaaagtgttggacgtttcttatcaaatatggtgatgcctaacattggggcatttattgcgtggggttttattaccgcactttttattccgacagggtggttgccaaatgaaaccttggcgaagttagtcggaccaatgataatgtacttactgccattattaatcggttatactggcggtaaattagttggtggagagcgtggtgcagtagtcggggcgattactactgccggtgtgatcgtcggtacggatattccaatgttccttggtgcaatgatcgcaggtccaaccggcggctgggcaattaaacgttttgacaaatgggctgatggcaaaatcaaaagcggttttgagatgttagtcaataacttctcttccggtattattggaatgattttagccattctattcttctggattatcggaccagctgtaaaagtagtttccggttggttggctagcggtgtagatgtacttgttcaagcaggcttattgccactcacctcaattttcgtcgaacctgcaaaaatcttgtttttaaacaatgcaattaaccatggtattttttcaccgttaggtatccaacaatcacaagaattaggtcaatctgttttcttcctaattgaagcgaaccccggtccgggcttgggcgtgttgttagcttatatgttattcggtaaagggtctgccaaacaaacttccggcggtgctgctgtaattcacttctttggaggtattcacgaaatttattttccttatgtgttaatgaacccacgtttattaattgcagtgattgcaggtggtgcaacaggcgtatttacattggtattatttaatgcaggcttacaagcaccagcatctccgggggcaattattgccgtgttagctatgacaccgaaaacctctttcatcggtgtgattttatctgttatcgcctcttgtaccgtatctttcgtcatttcttctttcttcttgaaaatttcaaaagaagaaagcaaaaataccctagaagaaatgcaagcagcttctaaagcaatgaaaggtggtaatacagcaacgaaaagtgcggtgatagatttgaacgaggtgaaaaaaatctttgtttcttgcgatgccggtatggggtctagtgcaatgggtgccggaatgttacgtaagaaagtaaaagatgctggcttgacaattgatgtaactaactgtgcgattaatgatttaccggaagatgcccgtttagttattactcatcaagatttaaccttgcgtgcgaaaaaacaagttccgaatgcaatacatttgtcattacaaaacttcttagataacaaattctacgacagtttagtgcttgatttgcaagctgcaacaaaagatgctgtagtaccgatagcggaagaaaatgcgattgacgtcaagggtacaacatttactcttaacgcagagcaaattttcttgggcttgaatgcagacagcaaagcggatgccattcgtttcgccggtgagcaattggtgaaatttggtttcgtgcaaccaagctatattgatgcaatgtttgctcgtgaagaattagtttctacttacttaggtgaaggtttagctgtgccacacggaacagcagaagcaaaagatgcggtgttgaaaaccggtattgtagtttgccaatatcctcaaggcgttcgttttaccgacgaagaagacggcgtagcgaaattagtaatcgggattgcggcgaaaggcaatgagcatattcaagtactaaccgcaattactaacgcattggatagcgaagaagccattgcaatactaacatcaactgatgatatagaaaaagtgctgaccttattgaaagcttaaaagtgcggtaaaaaatggcgtagttttgactacgccatctttgtttataattttattgattgggagagcaaaatgaacgcattacatttcggagcaggcaatatcggtcgtggttttatcggcaaagtattagctgatagcggagttcaagtaacctttgccgatgtgaatgaagcggtaattgatctattgaaaagacatcaatcttacaacgtgaaaatcgttggcgacagcattaatgcgatggaaagcgtacgtcatgttacgggggtagattcaaaagacacaaaggctttgattgagctgcttaaaacggttgatttagttaccactgctgttggtcctaccgtgttaaaaattatttccggaactatcgccaaaggtattgaagctcgtttaaccgcaggcaattttaagccgttaaacattatcgcttgtgaaaatatggttcgtggaacgacctttttaaaagagcaggttttcacacatcttacagaggaattgcaagcagacgctgaaaaatatgtaggtttcgttgatagtgcggtagatcgtattgtgccacctgtgcaagaagatatatcggatcctttgttggtaacagtagaggaattttgtgaatggatcgtagataacacccaattcaaaggtgatattccaaacattcaaggaatggaattaactgataatttgatggcatttgtagagcgtaaattattcaccttgaatacaggacacgccgtgaccgcttatttcggcaaacgcaaaggctatcaatttgtgaaagaaagcattgaagatcccgacatcaaagagtttgtagcggctgtcatgcaagaaagcggtgcagtgttaattcagcgttacggttttgaaccgcaagcacatgccgcttatattgaaaaaattctcaagcgttttgctaatccatatttagtagataatgtggaacgtgtgggtcgccagcccttacgcaaattaagctacaatgatcgcttaatcaaaccattgcgaggtactattgaatacaatttagctaatcagcatctaattcgtgcaatagcttacgcactgactttccgttgtgaagatgatccgcaagcagtagaattagcacaatctttggcagaaatcggtgtaacagaaacgttgaaaaaatatacggaattgcaagatgtcgttattattgagcaaatagctcaagcctataatgaagtaaataaatcttagacaaaagagcggtcagtttgcaaaacttcctaaaaaatgaccgcactttctctttcaagcataggaaaaacaagttgttatctgaagatcctatttatgaaaaattaaacggtactgtttccgtgcgaggttttatgattgctactgtggcaatttttgaagaggcggtagatagtctgatcaatcgagtatttcgaaaaacagattttgtggtgcagtcggtgattgactctctttttaccaacgacggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttgatcatttaaataaattggtacacaacacaaaggtaagcattgattttacagctaaaaacgcatcttaaaaaacaggtaaacaggtagtataagatgtctataatgaattttttagctgtaatttttccagtaatttctgatgaattcccccaaaactaccatttgacatgaccaaaatatgatcttcaggttgtgcctcagtaacaattaaatcaactaagttgtccagatttccagaccattttgccggttgcacacaatcattagcaatttcaactacattccaaggaatatttttcggttgcaataaaaaaacataatccgctcttgccaatgccggtgctatttcatctttatgaattcccattttcatcgtatttgagcgaggttctagcactgccaaaatacgtgctccgccaccgaccttgtctcgaagtgcggttaatgttgcaagaatttctgccggatgatgggcaaagtcgtcataaacagtaactccatttacttcaccttttacttccaaacgacgtttcgcattaacaaaagaatatagtgcttgacaagcatccttgacttgcacgcccacatggtaagctgccgcaatcgccataagtgcattattcatattatgttgaccgacgatattccattgcacttcaccggctttttttccctgatgataaacagcaaaatgcgaactgtcatgagctattctttccgcatgccattcctgatcttgtcccaaaaaatgcatttcagaccagcaacccatgtctagagtttctgttacagattgttcatgagcaaaggcaagaatacgaccgctcttaggcattgttctaatcatatggtgaaactggcgttgaatcgcttgtaggttgtcaaaaatatctgcatgatcaaaccctaagttattgataataagcgtttttggattgtaatgtacaaatttggaacgtttatcaaaaaatgctgtatcgtattcgtcagcttctataacaaaaaatggactcttgcctaagcgtgctgaaacaccgaaattgccggctattccacctattaagaaccccggttgcaagccattttgttctaaaatccaacttaacataccggttgttgttgttttgccatgtgttcccgatacggcaagcacccagcgatcacgtaataaatgctcgtgtaaccattgcggacctgaacgataaggtaagctattttccaacacatactctacgcaaggattaccacgtttcattgcattgccaatgacgactaaatcaggtgctggttgcaactgcgaaacgtcaaagtgcggtatgatttcaataccattttgttgtaaaaaagtactcatcggagggtaaatattcgtgtctgaccctgtgattttatagcccatttgtttggcaatgatagctactccccccatgaaagtgccacagatacccaaaatatgaatatgcttattgttcatttgtttctattccccaaaatgtataaaaaatgtgttatagatcacattgtgagaaatcaattcattcgttaaaaagtgaaggttgttataataaagcaactccaactgagagtaaatttaaattatggaaggattaaattatgaaaacattaggacaatttattgtagaaaaacaagcagaatatcccaacgctaaaggagagctatcagggattctatcttccttgcgtttagttgccaaaatcattcatcgtgatataaataaggcaggactaaccaacaatattattggtaattccggcgttgaaaatgtacaaggggaaacgcaaatgaagttagatttgtttgcacataatacaatgaagcaggccttgattactcgtgaggaagtggcaggatttgcctccgaagaagaagaaaattttgttgcctttgatactgaacgtggtcgcaatgcaaaatatgtcattcttaccgatcctttggatggttcctcaaatattgatgtcaatgtggctgtcggtacaattttttcaatttatcgccgtgtttctcccattggtacacctgttaccttagaagattttttacagccaggacataaacaagttgccgccggttatattgtatatggttcatcgacaatgttggtttatactacaggcaacggtgtaaacggctttacttatgacccctctttaggcgtattttgtttatctcatgaaaatatccaaataccgccaaacggtaaaatctattccattaatgaaggacagtatttgaagtttccaatgggggttaaaaaatatattaaatattgtcaagaaaaagataagtctactgaccgcccttacacttcacgttatatcggctcgcttgtttctgactttcaccgcaatatgcttaaaggcggaatttatatttacccgagtgcaacgacttatcctaaaggaaaattacgcttattatatgaaggtaatccgatggcttttcttgctgaacaggcaggagggatcgcaagcgacggcaaagatcggattttagatattcaaccgaaagaattacacgaaagagtaccgctctttgtcggctcaagagaaatggtcagaaaggccgaagaatttatgcgtgaattttctgaagaataaccatttgaaaagacactgttttgtgtcataaaaaatctgcaccttaatcagttgattatctagttcaacttttggggtgcagattaacatgtatatcggttttgagccttacttgacagaaattagaatttataatttacatttaaaacaaatgtgcgtcctcttgaatagttgtttaaggttttttggtacccatcgcccacaccaaaaataaaggtcatttggcttgcagaatcattattcgcatctaatgggctaatatatcttttatcaaagacattttgaatttcccctttaatggttaaattttctgtcggttgatagatggcataaagatcaaaaatcaccggttgtgctttgatttcttctgtaccggcaattcgtacataagtaaggtatactttgccatctttagatttgaacgtccccggtaagataacatcgccatctactttatcaactttagctcgtttacttttaccgtagtatttggcaatgccgcctaatgttaattttccgtcaaataaacgtgttcctaggtcaagggaaccgtaatctttcggtagagacgatattttacttaagccgaacccttgtaaatattttccactgctactaccgtcatttacagcactactggaatcggaatatgaacttggctgattggttttttgtctagcataggataaattggcatagaaccaaccgatatcataatttaattcaaattctattccttgcattttaacaataggcgatgaagcaacaggaatgatctccgcttccgtaccgccggtaaactcttgtggcttaaaaataccgtgagtttgtgctgctgctgtagaactaagtttattttctgcttttttatagattgttttacccccttcgtagttaatatgggtaatatgtgcaacgcagtcatcaacggatacaggtttatcttttcctctatagctgttcgagctacattcctgtttgacatttaaaatataatctctgattttcgtttgatacgccaagattttaaagcccagtacgtcgaaatccgaaaatacgccatttttataaccgttaatcccgaattgaatagttttggctttttctgattttaaatcggttctcaccgctaaatcaccgatttcagagaaatacatttctttgatatttgggacacgatgggttttggcataactgacaaagggcgaaaagagcgggtgaaaatccgccgagaatgaagccgaataattatcatgtgatctggaaccgcctttttctagggtatattccataggtctacatccagcaatatcaacatacccattataaaattttggagtgcatcctaattttatggcaccttctactccgtataaatcaacaagatcttttgaggtattatctacccatacagtgagacctcgatatttttttcttgtctcatcccaagctccattaataaacctattccgtcgaaaaacctgtccactgtatttataaatttggcgattggcatttaattttaaggtataaatatcgtatttaaaggtttggtcaaaatagagggttttaaaacgttgttcgccgtcaggttggaacgtattggattttgtgctgtgataaaaacaaggaagataacctggttcacctctatcagggcaataatataaattcggagcaaaagttggctcaccattctcaaaattataggctaattcacttggatggcgatttttactgtatttatttttgaggatattggcacctaatgttgcttcataagagaatttttctgttatcggaatggaaaaactcatatttatatccatggtttttgcactatttttgctttccaacatatctttcagctttttgccattaaatacgcttcccttgtgataggtttgcgtagaggtattatctgccaagattaattcaaattgtaaattctctttcgggtttaattggtagtttaactggtaatttttattctctaaatttctgccggaaagtgcggtcgataaagtgcggtatgaaagaatggctttattatatttatcattatattcaattttggctaaatggcttttgggataatggagtaatttatttggatcatagggttgacgattgtacttttctattgcttgcagagtacaatgatcttgccaaaatccccctttacaactttctcgtgccagtctcggtaaattatcttctctatctacatctacaatattcgttccaccacctactttaaaattttgtgagcttttacgccaactataggcatacataaaacctaatgttcttgtatcggaaaaaggatagcgaaaggcaaccgcacccatataattaggccctatagcgtttgtaccccccccgcattcaataaaatacccgctctattaccttcacttatcacatcatcaacaccgattgttctaaagttagcagatccgattaacccatttacaccgccttttccgctaacgccaccacgttgaatatctacactggtaataaacgcagggtcaatggttgcaccgaattgagaggttccaccggatttttcgctgttatctcccgatgtggcaaaaaaggtttgggaaataccgtccaccatcgtattcacccgtccaaatcccgtttgaccacgaacgttcaccgataccgtccccgaacttttatcaaggttggtaaacgcacccggtaccgttctgatgatgtcatcaatagattgcgttgacgtggaaatattttctctcacactggttgcccccgcttttttaaagacttcctgtttaggtggtagcttatattctacgttaatttgatcgagcatttcttccgcataaacacaagtgcttaatacggaaaaagctaccgcagtgagtttaaatttattagacataattttcctacttatgtatggttaaaaagattggtaaaaaagtagggcagttatataaaaatatccctcgcatgtcaattaatgataataatttttattattgttttatttccaagaatatgtaaagcctactgtgccattgcatttttatacaccaaatctgtaacgccaaacacaacggcactgtttcccgacttaatgtccgcactggcagtgtctgccgaggcatctaatttggaatcgtcagcgactaataaaatagtcgatgcattagctactatctaattgcattttaccggtcgagtagcaacgttccatttgattttaaagatggtattcatagtgggattccttgtgtgaaagataaaaaataagacctagttctcatatgccaagaactaagccttatcgaagaaatgaataaaaaagaggtgtattcgttagttaaaaacgaatacaatcgtgctgtgctgtcatcatagattatgaatttcttgcgtcattcttcaaaccgtctggttgtataaaaaataaatctttttgtctaactctaacaaagaaataaaaatacatttatactgaaaattttaatttctttgttttcattgcataatagtaaaaatctcatagatggaaggaaaaaataatgaaaaatatgttactgatgagcagttctaaatacaaagataccggttacttaattcatacattaccttggttggatcaatttttgatggcatataaaggtaaaaagctcgcctttatcccttatgccggcgttactcgttcttttgatgaatacgaaatagcggtgcaacaagctttatcttgtttaggcatggaaattatctccgttcatcacggcaaaaaacatgcagatattattgagcaagccgatgtgatcggtattggagggggtaatacgttttgcttattacaacggatgtatgaatataatgtcatgaatattattcgggagaaagtaaataacgggacaccttattttggttggagtgcaggggcaaacgtagcaggtagttcaattatgacaactaatgatatgccgattatttatccaccatcttttactgcgttaaatctatttccacatcaaatcaatcctcattttatttcaagcaaaattcaagggcataatggagaaagtcgtgaggatcgattaaaagaatttttaatcatcaatccgaccgcacttgtatatgcgttgcctgaaggtactgcgttgcatgttcaaggagaaaaagcaacagttcttggtgaacaaaaggtgttacgttttagcgaaaatatgcaactgagtaccttagcacctcattcgacatttaattattaaggatataactatgatacagtttaattctattgtggctattcttggcattatcgccacggtttatcttctcattaaaaaatatgaaactcgtacagtattaatcagtgttggtttgttgatggcaatgttgactttcaaaccaatggaggcgttagatgcttttgctaaatccatgaccagtagcggtttaatcatggctatttgttccagtatggggtttgcttatgtgatgaaatacactcaatgcgatacacatttggtacatttaatgactcgtccgttaagtggtttaaaattctttttaattccgattgcaacagttattacgttctttattaatatcgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaacaaacggaaagtactttcagtaaggtgaatatattctatgctttagcacctctcgttccattgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcctatgccaatgtattagggatcatcattgccgcaagtgtatttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataaatataagtaagactgaccgcactttgataattcatttgacaaggtgcggttaaagtttggagagtttaatgggggatatatgacgaatttagctagattaattgaatggcgaagagaatttcaccgttttcctgaaactggttggacagaattttggacaaccagtcgcatcgctgattatttagaagaaatgggggctgagattttactcggcaatcaaattattcattatgattttgtgcgtggtcgtgatacgaaattagttgagaaaggcattgaaagtgctatttcttatggtgcaaaaaccaaatggctagaatgaatggctatacaggttgtgttgctgtatttgattctggtaaacagggaaaaaccttggcattacgctttgatatagattgtgttaatgtgactgaaaccaatgatcctaatcatttacccaataaattaaaatttgcctcattaaatctagggtttatgcatgcttgtggtcatgatggacacatcacaattggtttaggtattgcgtcatggctttcacaaaataaggataaatttaacggtaaagtcaaaattgtctttcagcctgctgaagagggagtgagaggcgcagcagctattgctgcaagtggagtgattgatgacgcggattattttgcctcttcccatattagcttttgtgccaacacaggtactgtcttagcaaatcctcgtaatttcctttccacaaccaaaattgatattcgttataaaggacgacctgcacatgctggtgctgctccacatttaggtcgaaatgcattattagcagcggctaatgccgtaacacaattccatagcattgctcgtcatggtgaggggatgtctcgaattaatgtaggtgtattaaaagcaggtgaagggcgtaatgtgattccgagcagtgcggaaattcaacttgaagtacgtggtgaaaataaagagattaatcaatatatggtggatcaagttatgcaaattgccaaaggcattgcgattagtttcgatgtaagttatgaaactgaaattatgggtgaagcagtggatatgaataatgatcttgagttagttaaattgatcgaggaaattgccattcaacaacctggaatcaatgagtctactgctgattatgcgtttaatgccagcgaggatgcaacgattttagggcgtcgtgtgcaagatcatggtggtaaagcgatttattttattattggtgctgatcgtacagctgggcatcatgaggcaaacttcgattttgatgaaaatcaattgctgactggggtaaatatttatattggtttagtacagcggttattggggtagtattgagtttttaatttattttcgattaaaaagtgcggtcagtttttcatgaaaattaaaactaccgcacttcttgtctattgaattattaacagttctagcagttttttttgctttcaggtacaatcagccgattaaattttatcttatattaatgaaaaacttttagattttatttttatgaaaaatattcgtaacttttctattattgcacacattgaccatggtaaatcgactctttccgatcgcttaattcagagttgtggcggtctttctgatcgtgaaatggaagctcaagtactagattcaatggatttggagcgtgagcgaggaattactattaaagcacagagcgttactttaaattacagagctaaagatggtgaaacttatcaacttaactttatcgatacaccgggacacgtggatttttcctatgaggtatctcgttctttagcggcttgtgaaggggctttattagtagttgatgctgggcaaggcgtagaagcacaaaccttggcaaactgttataccgccattgaaatggatttggaagttgtacctattttaaacaaaattgatttgccggcggcagaacctgagcgagtcgctgaagaaattgaagatattgttggcattgatgccattgatgcagtgcgttgttcggcgaaaaccggtgtgggtattgaagatgtattagaagaaattgtacgtaagatccctgccccggagggtgatccgaatgccccgttacaggccttgatcattgattcttggtttgataattatttgggtgttgtatctttagtgcgtgttaaaaacggtattttacgcaaaggcgataaaattaaagttatgtcaacgggtcaatcttataatgttgatcgtcttggtatttttacaccaaaacaagtagatacaacagagctgaaaacaggcgaggtaggttggcttgtttgtgcgattaaagacattttaggtgcaccggtgggagatacattaacttcacatcataatccggcaacctctgtgcttccgggatttaaaaaagttaaacctcaagtttatgcagggcttttcccaattagctctgatgattatgaatcatttcgtgatgccttaggtaaactaagtctaaatgatgcgtctttattttatgaacctgaaaattctaccgcacttggcttcggttttcgttgcggttttttaggacttttacacatggagatcattcaagagcgtttagaacgtgaatatgatcttgatttaatcaccactgcaccaactgtggtttatgaagtggaacaaaccaatggcgaagtgatttatgtagatagtccggcaaaattacccccactaaacaatattgctgaaattcgtgagccgatcgcagaatgtaatatgcttttgccacaatcttacttaggtaatgttataacactttgtgtagaaaaacgtggagtgcaaacgaacatggtatatcacggtaaccaagtggcactgacttatgaaattccaatgggtgaggtcgtgttggatttctttgatcgccttaaatcaacttctcgtggttacgcctcgttggattatggtttcaaacgttttcaagcagccgatatggtgcgtgtggatattatgatcaacggtgaacgagttgatgcgttagctttaattgtacataaagacaatgcacaatatcgtggacgtgaattggtggaaaaaatgcgagaacttatccctcgtcaacaatttgatattgctattcaggcggcgatcggcaaccacattatcgctcgttctactgtaaaacaattgcgtaaaaacgtattggcaaaatgttatgggggagatgtaagtcgtaagaaaaaattgttacaaaaacaaaaagaaggtaaaaaacggatgaaatctttaggtaatgtagaagtaccgcaagaggcgtttttagctattttacatgttggtaaagataagtaaggaaacaccaatgtctaaatcaaatctatttttcgttatattaattgtagcgggatatgccatttggaaattgcttgatcatttggcactaccgaatacattcaatattttattaattttattgaccgcactttgtggtgttttatggtgctataaccgttttgttatcttgcccaagcggagcagacaaattgctcgtgcagagcagcgtagcggtaaaatattaacggatgaagaaaaaagtaaaattgagccgatttctgaggggagtgaattgttagcttccctatttcctgtattgactttcgtacttattttacgttcttttctttttgaaccgtttcaaattccatctgtttctatggagccaaccttgcgtgtcggggattttttgttggtcaaaaaatatgcctatggcattaaagatccgatttttcaaaacacacttattgaaacgggaaagccacaacgtggtgatataattgtctttaaagcacctttagaaccaaatattgattatattaagagaatagttggaatatccggagatcgtgttttttatgatgaaaaaacgcgtcatgtgacaattatttataataaggacggcaaagaatgtgtttatgattgtcaaataaaggaatttagttacagcgagccacagcgtaatcctgaatttaccatgatcgttggtaaggatgcacaaggaaaagctatctatggcgatgaaaatcctttggtcttaactgagaaaggcgatgtggaacatcaaattcattgggatccacgcatttttaaccgcacttatatgtacagtggttaccgtcagcaaaaagattacgtaaccgaatggattgtaccggaggggcaatattttgtgttgggtgacaaccgagatcagagtgcagatggtcgtttttggggtttcgttccggaaaaaaatattgtgggtaaagctgaatttatttggttgagtcttgataaaaaacaagatgaatttccaaaaggcattcgtttctcaagaatgtttacctcaattaaatgacaaattattgacttaataaaacgccctttaaattaaagggcgtttctgtgttatgaaaaatccggtaaaagtgcggtagtttagtcgcaaaaaataatatgcctttcttttattttcaaatagattaaataggggtattatgttccattattttttatgtggaacatcaaatttacgtttcttattgatattcttgaaaaaaattatgcaactggaaaaattacaaaaaaaattaggtcaccaatttactaatcttgattatcttaaacaagcattaacgcatcgaagtgctgctgcatttaataatgaacgtttggaatttctaggtgattccattctaaattttgctattggcaaagcactttacgaaaaatttcctaagtctaatgaaggtgaattaagccggatgcgtgcaacgttggttaaagaacaaactttagctgttgtggctcgccaagttgaattgggtgattacttaaaactaggtgccggagagttaaagagcggtggatttcgccgagaatctattctatctgattgtgttgaagcgttaattgcagcgatttatttagatgcaggaatcgatgttgctttagctcgagtttatcagtggtatcaggaattacttgaacaaataaaaccaggagaggcacaaaaagatcccaaaacacgcctgcaagagtttttgcaagggcatcgcttaaaacttcctgaatatgaagtgatagaaattaagggagatgctcacaatcagtcttttagagtgagctgtaaagtggaaacacttactgacgtcgtttttggacaagggactagtcgccgtaaagcggaacaacatgctgctcaacaagctattgaaaaattgaaaattaaataactatacccgtcgggacaacatttttttgtccttgcataatatgagagaaaaaatgacagaacaagaaacttattgtggttttatcgccattgttggacgtccaaatgtgggtaaatccactttattaaataaaatcttaggacagaaaatttccattacttcacgtaaagcacaaacaacaaggcatcgtatagtcggtattcacactgaaggtgtttatcaagcggtttacgtagatacaccggggttacatattgaagaaaaacgtgcgattaatcgcttgatgaatagagcagcgagtagtgcaattggcgatgttgatctgataatttttgtggttgatggcacacactggaatgacgatgatgagatggtgttgaataaattacgtcgtgcaaaagcacctgtcgtgttagcaataaataaagtggataacattaaaaataaagatgaacttttaccttttattacagacgttagtcaaaagttggagtttaaagaaattatcccaatttctgctcagcgaggtaataatattcacaatttagaaaaaatagtccgcacttctttacgtaaaggggtacaccattttccggaagattatgtaacagatcgctcacaacgctttatggcatctgaaattattcgggagaaattaatgcgttttacaggggaagaattaccctactccgtaacggtggaaattgagcaatttaaacttaatgagcgtggtatttacgaaattaatggcttaattttggttgaacgtgaaggacagaaaaaaatggttatcggggcgaaaggacaaaaattaaaaactatcggtactgaagctcgtcaagacatggaacgtttatttgataataaagttcatcttgaactatgggtaaaagttaaatccggctgggctgatgatgagcgtgcattacgcagtttaggttatatagacgaataaaataaaacattaaggagacaaattatgtacttggaacaagtgaaaactgagttatttgaagcacaagatgtactaaataaatttatcagtaacgaacaaaatatcaagctcattcaacaagccgcattactgatttcggatagttttaaacaacacggtaaggtattatcttgtggtaatggtggttcacattgtgatgcaatgcattttgcagaggaactaacgggacgctatcgtgaaaatcgtccggggtatccggcgatagcaatctcagatgttagccatttaagctgtgtaagcaatgattttggctatgaacatgtattttctcgttatgtagaggctgttgggcaaaagggcgatgtattattaggcatatcaacctcaggtaactcaaaaaatgtattaaatgctattgaagcggcaaaagccaaaggtatgaaagtgattgccctgacggggaaagatggtggaaaaatggcgggacttgcggatgtggaaattcgtgtacctcatttccgttttgcagatcgtattcaagaaattcatattaaagttattcatattttaatcatgttaattgaatttgagatggctaaaattagacagtaattttttaacctttttgtactattacagagaaagattttatgtcatattacaataatgcaatcttccctttgcttttagtgtaaatttagattaaaatcgcaacccttgttttagggtcaataattcgtttattgaacaatattaaattttgcaaaatattaattaatcattgaggtgatggcttatgccagtaattaaagtacgtgaaaacgaatcattcgacgttgcattacgtcgtttcaaacgctcttgtgaaaaagcaggcatcttagcagaagtccgcagtcgtgaattttatgaaaaaccgacaactattcgcaaacgtgaaaatgcaacgcgtgctaaacgtcatgcgaaacgtgtggctcgtgaaaatgcacgtaatacacgtttgtactaattaaaaaatttttttaattaaactcgagttaaacagaccgtgaaacctcataggaatcacggttttgtttcttttataaattctctatcatatttgcttttatagtattattaggctagtttattcctatttgatgctattttagggattcatcttttttatgtcaggcaaaataccgcattcatttattgatgatattttagctagaacagatattgtagatctgattgattctagggttaaactcaaaaaacaagggcgagattatcaagcctgttgcccttttcatcatgaaaaaacaccttcttttacggtgagtccgaaaaaacagttttatcactgttttggttgccacgcacatggaaatgcgatctcatttttaatggaatatgataagttagaatttgttgaggcaatcgaagaactggcttctttgcatggtttagaagtcccgagagagaaatctacgcttgatgaaaaaacacgagttagttttaaaactaaacgcaatctgtacgaactaatgcaagaaattgcaaaattctatcaagagcaattaacgcaaaatatccccgcacagaattatttacaacagcgtggtttatcaatagaaattattcaacgttttcaaatcggcttttctccacagcaatctagtttttttataaaaaaatttgccacaaatagagaagaaattcagaaattatttgatgtgggaatggtaaataaacgagagagcggtgaattatttgatcgttttcgtcagcgagttacttttcctattcgagatagaagagggagagttattgcttttggggggcgaattattacccaaagtgataacagaccgaaatacttaaactctcctgagagcgtaacttatcataaaggttatgaactttatggtttatttgaagcgttacaaattaatgatagtcctgaaatgttggttatcgttgaaggctatatggatgttgtcgctttagcacaattcggcgttgactatgctgtggcatctttagggacagcaactactactgagcaattacaattagcctttcgttcaacagaacaaattatttgttgttatgacggtgacagagcaggaagagatgcggcttggcgtgctttagaaaatgcacttcctttattggaagatggtaggcaattaaaatttatttttttaccggaaaaagaagatcctgatagttttattcgacaatatggcaaagaaggatttgaggattatattcatcaagcacaatcattaagtgaatttttatttaatactttaagtgctaaagttgatttttcctcaacagaaggaaaagccaaattagcttctcttgcaattcctttaattcagaaagtgccgggagaaatgttgcgattgtctttacgtgatatgttcggtcaaaaagtaggcatatttaatccggacaagttagatagattactatccaatcaacaacaggttgaatataaacaaaaaattccgaaaacagtaaaaagaacaccgatgcgagttttaatcgcacttttattacaaaacacaaatttagctaaaattgtccctgatttatctccactaaaagttttacaagagccgggcttggatttatttgaaaaaattgtaatactttgtcgtgaaaatgttggtatacgagctggacaaattttggaacattggcgagacacggaatatagccaagcacttgaaattttagctacgtgggagcatgctgttgatgatgataaaattgagcaagaatttagagaaaccttgattcatctttacaagcagttagtcgataagcgtattgaagaattaattggtcaagaacgtatggttggcttaactaatgatgaaaagatagaattagcacaattattatcgaaaaagcaagaaaagaaatagttaatcttttataagaatggtagaattctccattcttcaatccttattaatcgaggcagatattaaatggaacaaaataaacaatctcagctgaaattgttaattgcacgaggtaaagaacaaggttatttaacttatgccgaagtgaatgatcatcttcctgaagatcttgttgatgctgatcaaattgaagatgtgattcaaatgatcaatgatatgggtattcaagtacttgaaagtgtgcctgatgctgatgacttgatgctcaatgaaaatattacagatgaggatgctgttgaggaagcgactcaagtattatcaagtgtagaggcagagttaggaagaacaacagatcctgtgcgtatgtatatgcgtgaaatgggaagtgttgaacttcttacgcgtgaaggcgaaatcgatattgcaaaacgcatcgaagaagggattaatgaagtacaaagtgccgtagccgcttatcctaaagcactcaattatcttctagaacagtatactttagttgaagaaggcggtatgcggttggctgatctcattaccggttttgttgatccaaatgcggttgttgaagaagagataattgaagccgacgacatacttacagaagatgatgaagaacatgtagaaagcaatgttgatgtaaacgatgaagaagaggaagaagatagcgaagataatagcaatgtagactctgattcggataacacaattgccccagaagttgctcgtgagaaatttgaagcactaagaatacaacaccaaaaaaccttagccgcaatagaaaaatatggtcgttcccgtaaacaagcaaaagatcatattcaagcattagccgatatttttactcagttccgtttagtgcctaaacagttcgatgcgttggtcaattatatgcgtgatatgatgaaatctgttcgtcagcatgaacgacaaattcaaaagctggtagttgatttggctaaaatgccaaaagaaaatttccaaaaattatttattggtaatgaaagttcagagggttggctggataaattactgcttgcaagaaaaccttggtctgaaagattaatacaacatgaaagtgcggttcgtcaaagcataaaccaattattaaaaattgaacaggaaaccaatttaactatttctcaaattcgtgaaatttgtgacaaagtggcacaaggagaattaaaagctcgccgtgcaaaaaaagaaatggttgaagcaaatttacgtttggttatttcaattgcgaagaaatacactaaccgtggattgcaattccttgatctcattcaagaagggaatattggtttaatgaaagcggtagataaatttgaataccggcggggttataaattttcaacctatgcaacttggtggatacgtcaagcgattacacgctctattgcagatcaagcaagaacgatccgcattccagtgcatatgattgaaactatcaataaattaaaccgcatttctcgtcaaatgttacaaaaaatggggcgtgaagccacatctgaagaattagctgaacgaatgggaatgcctgaggataaaattcgtaaagtattaaaaatcgcaaaagagcctatctctatggaaacgcctatcggtgatgacgatgattcccatttaggtgattttattgaagacaatacgttagagctaccgttagattctgcgacagcccaaagtttgcgtgctgcaacgcatgaagtgttggaaggactaaccccaagagaagcaaaagtcttgcgtatgcgttttggtattgatatgaatacagatcataccttggaagaagtcgggaaacaatttgatgtaactcgtgaacgtattcgtcaaattgaagctaaagcattgcgtaaattgcgtcatccaagtcgttctgaaaccctacgcagtttcttagatgagtaaatgatgagattaaagaaagttatcacgttcttttctcaaacattttggcacgacaaataatcaaaattaacctaaaaaatataatccctattgaaagaaatggctcaatagggatttttcgttatgctaaaaagtgcggtgattattcaatcctatttgagcatcaaacatttctaattgttcgcctcaattaagttaggataaaaagtaaaaaaatcgtttctttcctataaaaatttaggataaaataacgagaattttcacttgacaaataaaatagaacaggaaaaatgacagtctacagtctacagtctacagtctacagtctacagtctacagtctacagtctacagtctacagtctagtatattgcctaaaatcaaccttgcaaggtaaatttgttaggttggacatgttcaaacaatatcttaaaaatcacctatttcaacctcaacctttcggcgaaagtattattcgcctttttctgctatgccttaaaaagcaaggcatcgcctatttaggtttataacctatctctctaaagtttaataaataatcagtaagagataataaataaacaataacagattcgatcaataaccacttaataagtaattaacagataatttttaaagcgagtaaagaatatgaacaaaatcttcaaaaccaaatacgatgtaaccactggacaagccaaagtggtgtctgaattggcaagcaatcgccaaatagcgagcagttcgaagagtaaaccgaagtgcggtgcgttttggggtaattttttaggcatttttaaattttcaccgttggcgttgttgatgttggggatgcttggtgtgagcagtgtttcatatgctgatatagtatatatagatatggaagcaactacaggtgctgctggagtaagagaaaaatgggatttgtcaagttattggaaaaatattggacgtgaaaatattttaatagcacctgttcaacctaatagaaataatcaaaatttaaataggtatggtagtagaataaatacaaatgtacaaaaatctgtaatcataggtcctatggcggcaggtagagatgagcaagttggtatgactgtattaggtcatggtgcagtcggttayagtagtcaaacaactgcgatwgggaataatgtytatrctggwggmgrrcaagcyacagcgataggwtcagatgttatggcagcwggytaygcttckattgcyataggtaatgatgatatcttgagccaaggtggatacgccgacgcattaccgcaagatcttattatgaaaatttatgggtatgatggaaatcataacggaaaaactacttataaggacatattagacagagatatatttgtagataaatatgggaaaaaacctactcaagatcatagacactattctccaacttattcagccggaataggtgcaatagctattggttcaagatcggttgcttatggggatacttcacttgctttagggactttatcatttgctttagctaaaggctcaaccgctgttggtgttcgtgcttttgttagccaagatgcagatggaggtgttgcgataggagatcaatcaagggtatttgctactaactcatttgctataggaaacgaatctgaatcaacaaacaaaggtgctttatcatacggttcaggagcaaaagcggtgggaacgggttctgtagcaataggcaccaaagtagcctctaatgctaagataaatgaggcttcagctagaaggtttagagacaagcttatgcaagaactaggtattggaactattcgggaagataaacaaaaagaatttcatacaataataacaactgaagttaaagatttaaaaactggaannnnnnnnnnnnnnnnnnnnnnnnnnnnnnnnnnnnnnnnnnnnnnnnnnnnnnnnnnnnnnnnnnnnnnnnnnnnnnnnnnnnnnntagaattagaatatgaagaagaacgaaaggagtttttgtcaacaacgactgatggcaagaaaaaatcagtaaaaaagaaagagagagagggaaatcacgctgtaactgtgggttactataccgcaaatagtggagataataccgtagccataggcacagcttcctatgtaaaaggtcaaaattctgtcgttttaggagctttgaacaatgtcgggaaatatgcaagtaatgcggtagcgattggggttggaacaaatgtacataaagaaaactcaatcgctttaggaacgggaacaacagtaacaggtgcgggcgttgtggctatcggttccggcgttggtgtaacaaaagacaatacaatagctgtgggttatggagcagtaggagaatcaagcgaaagtattatcttaggaaatgaagcaaagataaaaaaacaagcaaaaaaatctatagttatcggtaatagtgcaaaagttgaaaannnnnnnnnnnnnnnnnnnnnnnnnnnnnnnnnnnnnnnnnnnnnnnnnnnnnnnnnnnnnnnnnnnnnnnnagaactggaaatgtccgctattgctatagggacaagttcatctgtttatgctacaaagggcgtggcattaggggataacgcaagtattggaaaagatgctagtagttcaatagctttaggtaatgatgccgaagcagatatgatgaactcggtggcgttgggttatcaatccacaacaaagtatttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtgcggtcggtttacgycgtattrttaatgtckcaccgggtgcgttggaytctgacgtggcgaccgtaggrcaattaaargctgtgcagtayaymaawaaagaagggttagtggtttattacacagttaaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttagtcggggcgaaaggggcgaatgaggtgattggttcgcaagatctcggtgacaaaatccgtttygggcatttagcgaaaggggagatttcagaggtttccgatcaggcgattactggggcacaacttgatgatcttaaaggtaagttggggttgacggtaaataaagatgatccaacaaaatttgataaagtccaatttgatgcagtaaatgtaaccgattcaagtgatacatcaggagtaataacaacttttgaagatgctatccgtaaaagtattgcagctatcaatagaggctataaatttgatgatggaactaataatyctartactaaagatacacctttttatttaggttcaaccattgtaatcaaagcaggggatgttacaaagtcaggtacaacgacagagaactatctaggcaaaaacctaaaaacagaatttaaaaacgatagttcaaaagcgacattcaccatcggcttgaaagacgatcctgaatttaatactgtaaannnnnnnnnnnnnnnnnnnnnnnnnnnnnnnnnnnnnaaacttgccgtcaacaaagagtatgtggataacaaacttcaaaacgtttcgacsaatttrcatttyttatcagtamaagggacggataaaggaactggttcaaattacaataacgacggggcaaaaggcactcattctgttgctattggggtgaaagcaagtgctacagcaagtgcgacgtctggtatagcsataggayataaygcwmaatctraagcaraaaatgcggttgytataggkasaratgtaagtatwgaygtaccgaattcwtttgttatggggtctaataatacagttacgcaaagctttaaagagacaaatggtgcggttgttgtgatcggtagcggaacaaaattagtagaatcaaaaagttctatcgctatcggtgcggtgtatgtaaaaggtaaaaacggagcagatggcactttaattgaaaacgctgcttggacagcctctatcgggaataaaaacaaaatcaaaaacggtacggatattgtggcgttaggtaataatatccaagcattggataagacagatgaaatgtctagtaatggaacaaagaatgcgaatacagatttaattctgattggtaatggagcgacagctgaaaccgcaaaagaaagtgtgcttattggggcaaaatcaaaagctgaaacgggtgcaaaaagtgcggtaattatcggtcatagtgctaaagctgagagagacgccgtcggtgcagtagcgattgggcaaggtgcaacagtaaaaaccgccgccggcaactccattgccttggggcaagggtcagaagcgactaaaaaagaaaccgcacttcatgaagctaaaatagagactattaatgttaaatttaatttcaaaggtggagtgagtgctgatgataaagaaaacaataaaaaatccgttttaagcataggtaaaaccggcaaggaaagacaaatcaaacacgtcgccgcaggtgcggtagataaaaattcaaccgacgctatcaacggaagccaactttacgctgtcgccgatgaattttctaaattagcggtgaatgtattgggtgcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaataggaataaaagataaaccttcttttaaaagtgtattaattacagaagaaattcctgaggatacgtcagctgctcctaagaaarrtamttatgataasyaygctgtcaacaaaaaatatttagacaaaagattagaaaaagtcgccgctaatttcacggttaagggggataatyctaargmtggaraaggwtataccttagataaagagcataatgaattaaatattaacggagatagtgaaaatatcacaaccgcagttgttgataataaaggaataaaaatatctcttaacaaagaattaaaaggtattacttcaattgctaataatgatacaaaaattgaattaaacaatggaactggtggaaatggaacaaaatctatcgttttcaccgctggaaattcagataagaaagtaacattaactgaagataaattcagtggtgtgtctgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggcactaatacaacctataaattcactgacagcggattagatttagctggcaaaccaatcacaaatctaggaagtgggttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggcttgacctttgccggaaatacaggtagtgaatttactcgtgagcttggttcgacagtaacaattaaaggcgacggaatggatctaacatcaaaagccgaaaatgatgctattacctttactttaaataaagcaacttctgtagataaagatgacgaaaaagtcgttacctcaaaagccgtagcggacgcgttgaaaaattataccaagactactgacttagttgataagttaggcacggcgtatttaaaagtagatggctcgaatattgnnnnnnnnnnnnnnnnaaaaacattcggtagcaatgtcggtattgctgaaatcaagttagatagtgaaaaaagcagcactgaattagtacaggcggatgcggttatcaagtatctaaaaggtaaaggaactaactctgtgaaaatytctgattcaccaraaactaaagcagagggcgatagttcgataagtataggtttagaagctattacaaaaaattcttattccattgcgattggctataacacaagtgctacaaatcgcaaatcattggtgttaggtagtgatagtaccgtggacggcgaagagtctgtggcaatcggttcaacgaataccgtgagtagtaaatattcaggggtattaggaaaaacaaatacggttagcagagagcattcctatgttgtgggtgcttataatgacatcaaaggcgaacacacctatgtcttgggttcaaatattacgacaactaaagatataacaaatgctgtcattttaggcaataaatcaaaagctgtatcagatgcggtatcagtgggtagcgatactaaacaaagacgaattgtttatgttgcaacaccaactgataaatatgatgcsgtkaataarcaatatgtcgatgcacttggattaaaattcaaaggtaatgatgataaaaatatacacagaaaattatcagaaacattagaaatagttggtaagggattaaataaaaaccaaactactaaatttaatggcacaaatggaaatattgcggttataaataataagcaaaataaattggaaatatcattaaatagagatttaaaaggaattaaatctattagtgatagcaagaataaaaatatagctactgaaataagattcaatagaaaaaatgacacaaacagtatttctaatagtttgataacgaacctaactatttcttcaaatggaggcacatttgaatttaatagaacaggtttgcatatcaacaataaacaaattacagggttaagaagtggactattagaaaaacataatggacaagatggagaaagaaaagatttagactatttaataggaaaagactttgataaatcatcgattaaaactcatgcagtcaatgttggagatttagcgaaaatttctaaggaaatagttgaaaaaggatataagtataaagctgatattccgtcaaataatagcaatgataccagcataaaactaggctcaaccatatctattgttaaatggacagacacaccggcatcagggactggacaaccagcagtaactgttggcacaggaacaacttctcaaacatcagctgttaagtacacaggagataatttaacaactcgatatacctatgtcggtggcaacgctaagatagaaattggatttaacgaaagtcctacatttaaagctgttatgcttgatgaagatcaaacatataatggcggaaatgtaggtgatagcaaagaactcatcactaaaggttaccttgaaaaagcgttagatagctttaaattcaatgtggcgaatggtgatggtaagcttatagaaattggtcgcaacgacaccttgaaatttaatgctggcttgaatattcaattaacgttagctaaagagggcgaaaaaccggcaaatggtacaacgtctaccattaattcaagtgcggtaacttctaccccagctccgaccgctccagccgtggcaagtagttcagacagttctgaaccagcaagcacgtcatcaggtagtgcaggtggtgcggttgcgtcaggtggtataaatggcgatagtgcagatactgtggtcgcttcaagctctccaactgcgggaacttcaagcacaacaacgaccacgccaagcgatacgagtacaccaaccactactaccccaacaacggcagtggtaaccattggcacgacngakgatttnanmaatatcacctcgatttcctctaaagctggaagtgcggrcggaaatgrtgcaaatggytcaactggagamgtgactaaacttaccttagatcccactgatggggcgactttccaagtgggtagtcaaggtgcgaaagtgaatatyaatracaagggtattgcactgatgccacaaggggcgaatggtgcagatggggcgaataatccaaatgctgaatcgccatctattactattaacgcaggtacaaaaccggcggatccaaatagcttagaatcgtttgagaaaggtcaagaaccttctattacgttttcmacmaarrawactgatggyaakaaaatcggctcaggcaaaatcaccggtcttgctgatattaaaccggaggaaacagacggcacccttgcagcgaataaaaactatgtggatgaaaaagtatccgacttaaacaataatcgcccgtttgatttttatttaggcaatgaaaaagtcgtgaaaggggctgatggcagtttccacaaagacggtaaacctagtgaaaaactttctgaggaagagaagaaacaagtcgtgattaaagccgaaccaagcaccgcacctatcgggattagcaatgtggcgagtggtttgggattannnnnnnnnnnnnnnnnnnnnnnnnnnnnnnnnnnnnnnnnnnnnnnnnnnnnnnnnnnnnnnaaagctgttgaggaaaaagtaaaagcggtgggtgagaaagctaaagcactttcggacaaagcacaaactttcacggatttagcgttagcggtaagtagcttagaacaggcrataaatgcgttgccagmrggcgaggataaaacgcaagcagaagctaagctaaaagaaagcaaagaaaaacttgaagcggttaaaaaagagcttgaaacagcaaaaactgatttggctgatgctcaaaaaggcttaacagaagcgaataaagcctatgaagctaattataagggctatgcaaaagttgaagagctagtgaaaccggaaagtgcggtggatttaaccaacgtggcaacggttggtgatttgcaagcggtggcaaaatctggcttgaagtttaaaggcaatgannnnnnnnnnnnnnnnnnnnnnnnnnnnnnnnnnnnnnnnatcacaggcgagggcgacacatttaacagcaacctcaccgccgccggcaatatcaaagtggaaatgtcccaagacggcaaaggcttagaagttaaattgtccgataagctacaaaacatgacttcgtttgaaactcgtgaagtgaacgataagaaagcccgcttggatagcaacggtttgagtgtggaaaatacaagcacaaaagaacgctctcatttaagcgaaaaccgtttagcgttctttaaagatggagcgttaggattgaatttagatggtaaagagcgagccttaaaagtgggtgaaaaagcgattattagcattaacaaaaacaatgaggctttagttgaagatctcaacgcttctagctcaggtcaggcaattgcgaataaaaactatgtggacgcaaaaaataatgaattgcgtacacagcttcatagtgttaatcgtgaatcacgttcaggaattgctggtgcaaatgcggcagctgcgttgccaatgattgcgatgccgggtaaatcagcacttgctgtctctgcgggggcttataaggggcaaagtgcggtggctttgggctactctcgtatgagcgataacggtaagattatgttgaaactacacggcaacagcacctcaaccggcgattttggtggcggtgtcggtattggctgggcatggtaagtaacgccctttgagctaaaaaagcagtgaatgatgatctgttccttaatcagttggttgtttagtccaacttttgggtgcagatcggaatcactgcttttttgatgcggatttactatgatactttttaatggtgatggaactgtaatatcatcaccagcccagtattaggcttaggtgaaagcggttagaatacattaacttctgtccttgaaaaagaaatattcattgagggtgatagaagaaattcactgatgtattaggggagttagtaggaatttcgttttttagagagaggaggacatcaatatatgaaatatwmgtttatttcatratkaatcrgcatataatgtcarcytttcatgttaaataaaggattcgcattatggarttttctgtttatctacaattttttatyggrttratygcsttggtyaatccaattggrgttgttcctatcttttatacswtgacwkcwggtcaaartcgtrytcarcaaartyayactgcyatgattacttgtttttcrattgtmgttattttattgrtcagtttttatttyggtaatttyattttaagytckttcaatatatcsattaattcattcmgaattgcyggmggtattgtcgttgtgatgatmgctttaacyatgattaayggaaaaattggtgatcayaaaatyaayaargaggaacaaaaagaggayttyagtgaaaaagataatatygcwgtsgttccgttagctatgccrattttagcrggwcccggwtcaatyagtgctactattgttytwggttctagtcagwrttcatggmkcgaatacytrtattcrtctattacratcgcactttttggtytaacytgytayattttrtttcgttattcagarccrsttatmgaaaaattaggtaaracaggatcaaatgtaatwacaaggattatggggttattgctaatgtctttaggtgtagaaattatyactacyggcttaaaaaatwtaggygtwttttagcttcaaagccatattatccagtaaaaaatacaccgcacttttttatgctaaacattgttttttttcagtataataaraammattttttcacaacaatgwtggaacaakarttatgatraayacaaaatttaaygtaaraacctttcagggkatgattcttgccttrcaagatttttgggcaagcaaaggttgttccgtagttcagccttttgatatggaagtaggtgcggggacatcgcatccaatgacttgtttacgtgctttgggacctgagccgatggcgtttgcctatgtacaaccctcccgacgtccaactgacggtcgttatggtgaaaacccgaaccgtttacagcattattatcaattccaagtggtgatcaaaccctctccggataacattcaagaactttatttagatagcttaaaaatgctcggtttcgatccaacccaaaatgacattcgttttgtagaagataactgggaaaatccaacacttggtgcatggggtttgggctgggaagtatggctgaatggaatggaagtgacacaattcacctacttccaacaggtcggaggcttggaatgtaaaccggtaactggtgaaataacctatggcttagagcgtttggcgatgtatattcaaggtgtggacagcgtatatgatttggtatggtctgacggtgaatttggcaaaactacttatggcgatgtattccatcaaaacgaagtagagcagtctacctataatttcgaatatgcagatgtaaatttcttgttccattgtttcgaacagtacgaaaaagaagctcaatacctaattgatttggaaaaacctcttcctcttcctgcttacgagcgtattttgaaagcggctcatagttttaatctacttgatgcacgcaaagcgatctccgttactgaacgtcaacgctacatcttgcgtattcgtgccttaaccaaaggtgtggcggaagcctattatgccagtcgtgaagcattaggatttccggggtgtaaaaaataatgacaaaaccgattttatatttcgcccactggtgccctgataccgccccctttgtcgcagaacttaaacgtctaggcgtagaatttgacgagtgcgacatcacaaagtgcggtgcaaatcttaaactttttttacgtcttcgtgactaccacccagcctttaatcacgccaaagccaaaggctatataggtattccggcattgttgttagaaggggataaagtggtgttggatttggcagaattagaagggatttnnnnnnnnnnnnnnnnnnnnnnnnnnnnnnnnnnnnnnnnnnnnnnnnnnnnnnnnnnnnnnnnnnnnnnnnnnnnnnnnnaatcaaggagaaaaaatgaaatacgcctttatcgactatgaaaacctgaattcattaggtggtttagcattacaagagtatgatcgaatttttctctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatccaatgatcagggctatgatggtatttgtaactttattcaacataaaaaacaggggcggatttgtcatggaacaaacggcaactagaaattttccagtaagattggaaagcttaaaaaacaatattcgtagccgttgcggtttaaataatattgatataaaagaggctgaaaaattggttgttctagtaattgataaattgctttcagaaaaagtaataaaaattgctgataacaaagtaagctatcctaagcgatagcaaagagtgaatttttattatttatgccactttcttttaagaagaaagtggctaaaaatttaaatactcggattgaattttgctatcaaaatgtgatctaacattctgtattacatgaagatctacatcacaattaaaccaagtttattattttgtcatatcgttaggaaaatgatgatgagcataaactggcaaaagcaatatccgccgcttgtaaagtgcggtcaatatctgtgtcagtgtgtgctaatgacatgaaacctgcttcaaatgcagatggtgcaagataaacaccttgttctaacattttgtggaaaaatagattaaacttttcaacatcacattgaattgcttgttggtaagaggtaacttcattttgtgttgtaaagaagatgccaaacattccgcctacataattgactacaagcgggatattatgttgatttgctaagttttttaaacctaatgccaatttttttgtgagcattgctaaacgttgttcgttaccttcttttttcaattcatttaagcatgcgattccggcagacatagcaattggatttcctgataatgttcctgcttgatatacgggacctgtaggtgcaatatattgcataatttcttttttgcctccaaaagcaccaacgggcatacctcctccaatgacttttcctaatgttgttagatcaggtgtcacttcatagtaagattgtgcaccgcctaaggctacacgaaatcctgtcatgacctcatcaataataaatagagaaccatattcattgcaaagttgacgcaagccttgtaaaaaatcctgtttcggaaggatgcagttcatgttacctgcaacaggctcaacgataacgcaggcgatttgatcaggatattgttcaaaagcatttttgacagattgaagattattatattcgcaagtgatggtatgtttagcaaagtcttccggaacaccgggagagcttggttgtcccaaagtcaaagatccggagccggctttgacaagcaaactatccgagtgaccatgataacagccttcaaattttaaaattttatctcttttagtatagcctctagccaaacgaatagctgacatagttgcctctgttcccgaattgaccattctcaccatttcaattgatgggactaattgacaaatcagttccgcaagttcaatttcaagcggtgtaggtgttccaaaacttagcccattttctgctgtttttagtaccgcacttaagattgatgggtggttatgacctaaaatcattggtccccaagaacctacgtagtcaagatattgttttccttctatatcgaaaatatacgcaccgttggctttttctatgaacactggcgttccgcccacacctttaaatgctctaactggagagtttactccgcctggaataacttgttgtgcacgagagaataatgtcgctgaagttgtcatgataaatcctttaatatattgttaaaaacacactttgtattctactgtaaatgaagataaatttataaaaatatttataatacgaggtttttagatgttcttttacattatttattatgcacctaattgctcaacaaattgaattagttggtaaacacattatcgtaagcattattaaggtgcaattcttccttatttcgtaacgaattttgtcattccgttgggttaagagaatgaaaaaagaacgcagagaataaaatcatgaaatgtaatatcactttataaattttattaaaaaaacgtcagtttggataaaaaattatctaataataaaaaaaagtaaaaaaatgctagacaagtaattgtgaaactcttaatatacgccccgcaacgacgcgatgagcgctcgtagctcagttggatagagcgttggcctccggagccaaaggtcgcaggttcaaatcctgtcgagcgtgccaggcgacgttatatcaaatgtggtggctatagctcagttggtagagccccggattgtgattccggttgtcgtgggttcaagtcccattagccaccccaattagtcggcgagtagcgcagcttggtagcgcaactggtttgggaccagtgggtcgtaggttcaaatcctatctcgccgaccatttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaagtaggtcccaagggtatggctgttcgccatttaaagtggtacgcgagctgggtttagaacgtcgtgagacagttcggtccctatctgccgtgggcgttggagaattgaggggggctgctcctagtacgagaggaccggagtggacgcatcactggtgtaccagttgtttcgccagaagcattgctgggtagctaaatgcgggagagataagtgctgaaagcatctaagcacgaaacttgccttaagatgagttctccctaacgaagagttagtaagggatgtttgagactaagacgtagataggtggggtgtgtaagtgtagtgatatattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgattttattttgttagtttatttatattagtaagctaacaaaataagtttttttgcgactatagctcagttggttagagcaccaccttgacatggtgggggtcactggttcgagtccagctagtcgcaccaaataaataaatcaatgtaacgcatagtaacgcatttcaacccaaaagccttgtacaacaaggcttttttactatccgattaacgctagttgcgtcaggataaatcacattgaccttgaataatagtacccattttagtacccacgcattataattagtttgattattgggtactaaaattatacaacctcttacaaatacacaagtagaaaaggcaaagtatataacaggaaacaaagcagagttaaacgatggtggaggcttatttttacagctatacccatccggctcaaaaatttggagatttcgctataatcacccagtgaaacaaaaaagaacaaagctaactataggtaactatcctgatttttctattgctcaagcaagagcaaaaagagaagagtttaaagcattattagcacaatacatagatccataggcatataacgagcaacatagaacagagcaaaaacagagcaaaaaaaggacgcttttagcaattgccgagcaatggaaagataaaagagtgaaagagatagaacctctaacaatggctaaaaattgggagcgattaaataatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcatttatttcctcatttgggggcttacccaatagagaatattacccccccttttttttttactaattaatgctgtcaagcctctttacgagcaaggtaaaaatgacactatgcaccgcattataaatttagttaatcaagtattaaattacgctgttaatttgggtgttttatcatttaatccttgcctacaagctagcaaggaatattacaaagaactaccaaaaaaatcatcctgccatccattattctgaactcaccctattattggctgattttgaacaatctaacagagaggcattaactaaattgttatttaggtggcaattgttatcaatggtacgccctgctgccgaagctgtttcagtggaatggaatgaaattgatttaaataaaaaatttgggttattattcctgaagaaaaaatgaagaaagttagaacggggagattttcgcattctgtacccttatcaagacaaatgacaaaatattttagagcaattgaaaccaataacaggacatcataaatatgtatttccatcattcacaaaacctaatcaagcaatgagtaaagacacaattgctaattcgttgcgtgaaataggctatcaaggtaaacaagacgcccacggattgagggcgattgcaagaacttatttagaagacaatatgattgattttagacttgctgaaagttgtttagctcacaagataggggataaggttagtcaggtctataaccgtgctgactacatcgaacagcgtcgcccagttatgcaactttgggggtatgtgcaccagaattttttaatcaatcaaattgacagtaaaacctagaaaaatcaatgtttctaggttttttatttatcaatatcatatgaatatcgatttattctacttattttggcaatactagcgagaatgatatagtagttgtggtcagtcctctgagtaaagctgagtaaaggtaaaatatgaattattttcataggtttagcaaaaaatctcatttttcttaaaaaatttttatggtttaatacaccattattctaaaaatgagaaaaattaatatgatgacaacatttgaatgccgtgtacatacgcttgaatttgatgaaaattaccaaccagaaatgcagagtacccgtttaacgaccaactttgctaaccttgcacgtggcgaaaaccgcaaagaaaatttgcaaaatgtcattgcaatgattgataagcgttttaacgatttggcaaactgggataatccaactaatgatcgttattctgtgaagttagagatcgtgtcaatagatattgatatggagggaaaaggtaaattttttccagcactcgaatggctgaaaacctatgtcatcgaccataaaactggcaaaaaaattgatggtatcgtaggcaacaatttttcgtctttcgtgcgtgactatgatttcagcgtgttgttgttagagcataacagaaacaaggaagaatttaccgtaccgaaaggctatggtgaattgcatggcaagctattcaaacatctgttaacttcctctgcatataaagaaaaatatagtaagcctccggtgatttgtttaagtgttgcaactactcgtacttaccgcagaaccacaaatgttcatccgattttaggggtggaatatcatcaagataattattctttaactgatgagtattttgcgaaaatggggttatctgtgcgttattttatgccaccaaaatctgttgcaccttatgcgttttattttgatagtaattcagatttattgaatgattacaccaatcttgaattgattagtacaattgctacaatggaagctttccagaaaatctaccgtccagaaatttacaatgctaattctgtggctggtcaagtgtataaaggtagcttgacttatcaagattactctgtgatcaaagtagaatatgatcgtgttgagcgtacacagcttgcaatcaaacaaggtaaatatactgaagcacattttattaagccatataaagcaattttagatgcttggatggctgaaaaataaatcaagacagtatttttatttgatacattcgtagggtgggttaaattccgcccctacacatttatttaggaaaaccaaaatgagcaaaattcttctcccaacctctacagctggtagtcttccaaaaccggtgtggcttgctgaacctgaaaaactttggtctgaatggaaatgtcagggcgatgaactttttcaagctaaaagagatgcactattagtttcccttgctgaacaagttgcagcagggattgatattatcagcgatggtgaacaaactcgtcagcactttgtgactacatttattgagcatttagagggcgtagatttcaataagcgtaaaacagtgcgtatccgtaaccgctatgatgcaaatgtaccaagcgtaattggtgaagtttctcgtccaagctccatatttgtagacgatgcaaaattcttacgcaagcatactgataagccgattaaatgggcattacctggtccaatgacaatgatagatacattatatgatgcacattacaaaagtcgtgaaaagttagcatgggaatttgccaaaattttaaatgaagaagcgaaagagctggaagcagcaggtgtagacattattcagtttgacgaacccgcgttcaatgtattctttgacgaattgaatgattggggcgtggcagcattggaacgtgcagcggaaggattaaaatgtgaaactgcggtgcatatttgttacggttatggaattaaagcaaatactgattggaaacagactctcggcagtgaatggcgacaatatgaagaaagcttcccgaaattgcaacaatcgaaaattgacattatttctttagagtgccaaaattcttgtgtacctatggaactgattgagctggtgagaggtaaaaaagtgatgcttggtgcgattgatgtagcaaccaatattatagaaacacctgaacaggtagcggatattttgcgtaaagcactacaatttgtagacgcaaaaaatctttatccttgtactaactgcggtatggcaccgctctcacgtcaagttgcaaacagtaagctcaatgcgttaagtcaaggtgcggcaattattcgagcagaattagcaggttaatctgatatggtagaagtctctcaatttaaagatgcaatggcacaacttgcctcagcagttcatattgtgaccacaagtggtgaaacagggcagcatggttttacagcatcagccgtttgtagcgtgactgactccccacctaccttgcttgtttgtataaatagcaatgcacgtgcctatgagcattttataaaaaatcgagtgctaatggtgaatactttgactgccgaacaatcttctttatcaaatatattcgcctcaccattaagtcaagaagaacgtttttccaacgcttcttggacaacgttgactacaggatcaccgatgttacaggatgctctgattaattttgattgcgaaattacagaaattaagcacgttggcactcacgatattttaatttgtaaaattgtagatattagacaaagtgataagaaagaagcattggtatatcacaaccgctcttaccatattcttaaatgaaatttgtaaataaatcataagtcttaaaccgtaacttataagtcgataagttacggtgttaatttgaaaaaagagttatgattttattaactttcttagaaaatatttgagtctattgtatgtacgtctataaaataattgttctcttttttgatgtttaaccaatagttgactgttatttagttccttttctaatagatctagtgagaagagttggcaactttgttctaaatattgcattgcttccaacttatactgccttcttctatttagcttgaaatcagacaatgtagtatttggcatttgagtataagataatattttatgtaaagggattaattctaaattgaataaaaatgagatagttttgggcaaataaacagaatgtttattttgttgtaattcatagttaccaatcccaaaatctgctttcataaattttaagtgataataggcgaaaatattttttctcatatttctttgactgatgtctaaaaattctgtttccttgttttttttaaaaatgctatcttcatctaccctaaataaacatagatcaccatataatccacaataaggcgagctgtaagaaatataaagttcaccacaatgatcaataatattaattcctgaaacaggcaatacatcattgggataattttcttttaagtctagataagtctgttttagcaaaggtattttttctgcacaaagaattaaatctccgtctatttttatagcccattttttcgtagtttgactcaatgaaaagttatagtaattaaccaaactatggggattattaggttctaaatttttatagttatcactaccttgaggataaacaataggtaaatagtgaaaagtttttattttattaggataaagttttgcgtattgttcagcaatttcagcagtgttgtcttggcaattattatagacaatcaccaattcgtctaataaaggaagccagctttcaatagattgagcaagaaactctccttcattacgtaatcgcataaaaccgcttaagccttcagaacgagtgttggcttgaaaacgtgaaaaatcaatggtaggatttttgactgactgactgactgactgactgactgactgactgactgactgactgactgactgactgactgactgactgactgactgactgactgactgactgactgactgactgactgatttagcatattgttatttccggtctttttagagagaaaaatggtggagaatttccaccatttttcaatattattcacttctagtgactttaatcgccaactcttccaaagctttttcattagcaagactcggtgcgtcagtcattaaacaagctgcggctgttgttttcgggaatgcgataacatcacgaatattatctgttccggttaacaacatcgttaaacgatctaagccgaatgctaaacctgcatgtggaggcgtgccgaattttaaggcatcaagtaagaatccaaatttctcacgctgttgatcttcatcaatgcctaaaatatgaaatacagtttgttgcatttttggatcgaaaatacgcactgagccaccacctacttcataaccattaatgaccatatcataggcgtttgccaccgcacttgtcggatttgcttctaattgctccggtgtgaaatcttttggactagtgaacggatggtgcattgcagctaaattaccttcttcatcacgttcaaacattgggaaatcaataacccaaagaggtttccactcatctaagtgagttaaacctaaatcacgacctagtttcaatcgtaacgctcccattgcgtcagtagcggtttgccatttgtccgctccaaagaacaaaatatcaccgctttgggcagaagtgcggtcaaaaattgctttgattttttctgtcgttaagaattttccaattggactttgtatgccttctaatccagcgttgatgtcattaatttttacccaagctaaccctttcgcaccgtaaataccgacaaattgagtatattcgtcaatttgttttcgagtgatatttataccgtttggtacacggatgacagccacacgaccgttcgagctatttgcagggtcgctgaaaacgttgaaatctatatctttcacaatatcagctacatcgactatttctaatggattacgtaaatccggtttatctgaaccaaagcgttccattgcctcttgccaagtcattgtcggaaatttgcctaaatcaacgcctatggtatttagccataaaccatgcaccattttttccataatttcacgcacttccggtgcagtcataaaggaagtttccacatcaatttgagtaaattccggctgacgatctgcacgcaaatcttcatcacggaaacacttcacaatttggtaatagcgatcaaaaccggacatcatcaatagttgcttaaacaactgtggtgattgcggcaaagcataaaacttgcctttatgtactcgacttggaactaaatagtctcgtgcaccttcaggcgtagccttggtaagcattggggtttcaatgtctaaaaaaccgttttcatccatataacgacgtacaaaagcggtaattttggcacgggtttttaaatgttgagccatttcaggacgacgcaaatcaagataacgatattttaaacgctgttcttctgtattattctgattaaaatctaaaggaagtacatccgaaacgttataaacagacaatgctttagctacaacttccacctcgcccgtcgccatatttttattaatttgattatccggacgagcaataacctcaccttcgattttaatacaaaattcattacgcaatgcactggcttccgtcaatgcttcttgatatttcggatcaaaacaaacttgtacaataccttcacgatcacgcatatcaataaaaattaaaccgcctagatcacgacgtttatgaacccatccgcttaatattacttgttgtccaatatggctacggttcaatgcaccgcaataatgagaacgcatcataatgacttcctttatatctgaaactactgaaattagtcgacgaattatagctgaaatctcgcttatattgaaagagtggacggaatttatttgagtgagacttaaacttcttctaaaatgaccgcacttttttacacttttttagatgaaccataaaataatgaataaagattgtatttttgctgcacccattgaaaaactgggagattttacttttgatgaaaatgtcgctgaagtattccctgatatgatacagcgttctgtccccggatattccaatatcattactgccatcggcatgtttgccgaacgctttgtgacggctaactcgctagtgtatgatctggggtgttctcgtggtgcagccacgttatctgctcgtcgccatatcactcagcctaatgtaaaaattatcggcgtggataattcattaccgatggttgaacgttgtcgtcaacatattaacgcttatcagagtgatattcccgttgaaattttgtgtgatgatattcgtaatattaaaattgaaaatgcatcaatggttattttaaatttcacattacaatttgtaccgcaacaagatcgtcaattattactggaaaaaatatatcagggacttaatcctaacggaggattggttttatcggaaaaatttcgttttgaaaataaaaaaatggacgacttgcttattgatttacaccatcaattcaagcgagccaatggttacagtgaattagaagtaagtcaaaaacgcaccgcacttgagaatgtgatgagaacggatagtatagaaacacataaagaacgcttaaagtcagcaggcttctcccaaatagaactttggtttcaatgttttaattttggctctatggttgcgataaaataacaaaaaaacagcctctgaattaagaggctgactaagtttaactatgactttcataagcgagtagcgtattaaacataagcatcgcaacagtcatcggaccaacacctcccggaactggagtaatgaaactcgcctttttgctcgcttcatcatattgcacgtcaccgactaacttgccatcaactcggttaattccaacatcaataataattgcaccttctttaatccattccccagggataatgtgtggcttacctactgcaacaactagaatatccgcttggtgcacatgacttttcaaatctttagtaaaacgatgagtaacagtaactgtacagccggctaacagtaattccagtgccatagggcgaccaacaatatttgatgctcctacaataacagcatgttgtccgtacagatcaacgcctgtggtttccagtaatttcattatgcccaaaggcgtacaagcacgtaaggttggaatacgctgacaaagacgcccaacattatacggatgaaaaccatcgacatcttttgttggggaaatatgttcaatcactttagtagaattaattttctctggtaatggcaattgcaccaaaataccatcaatttgcggatcttgattgagttgttcgatgagagttaataattcttgttcagttgtttctgccggtaaatcataagattttgaatagataccgagttcctcacaacttctacgtttacttcccacataaacctgagaggcaggatcagcaccaactaaaataacagctagtcccggtgctcttttcccttgttgaagataatgctgaattttttcagcaacattaaatttaatgtttttagagagttcagtacctgaaataatttgtgcgggcattaattctttccttcaaatttgatctcaaatgatcaacataacaatcatttaaattattgaacatgaaaaacgttgctattgtgtcaaaaaaaagcgagaaatgtaagtcaatttgagagaaatttcatcaatcaaataaaaaagtgaaaaagtaattgactgtttatgaaagaaaattataatgcacctcatcggcgagtagcgcagcttggtagcgcaactggtttgggaccagtgggtcgtaggttcaaatcctatctcgccgaccatttttatatttcttattttttaaatgcgcccttagctcagctggatagagcaacggccttctaagccgtaggtcattggttcgaatccaatagggcgtgccatttaaatccttatatatcaagcagttatcactcaggcaataagttttaaatgtgtcacagatttgctctgtgccgtaaatgtgccattaaattcaaccttgtttgcgtgctctagcagatgatctgcatttaagtgagcgtatttttttaccatttcaagcgtttcccatccacctaattctttaagtgtgaagagaggagtgcctgcctgaacgtgccaactcgcccaagtatgacggagatcgtgaaagtgaaaatcaagcaaaaaacattttctagctgctgcattaaatgctttgcggttaatgtcatttagcttattattctcacgcccaacaaacacatattttgtgtgtttgccacgtaatgacttaagcaataagattgcttcgtcgcttaggagtagtgatcgtgctttacctgattttgcaacatcattagtcacgatcgctaccttacgcacaaagtctattttatcccaagtcattgtcagtatttccgtcctgcgagcacctgtcattaatgcaaacgcacaaatggctctcatccaatcactatttagcttggcaagtaagtcttttgcttgctcttttgtgatccatctaaccctaataggcggttctgcatttttaggtaggtgtgggactttgtcgaccaaccctgcctgatgagcaagatttaagatccgtaaaatagactgtatatacttgtttttggttgagttggtgagcggtttgtttgtgttcatattccgtgtagggatatgatttaggatttcttgagttgttaaagagctaagcacccgtccttggaatttctcacgccaatatttagcgtgtcgtttttttgtgcttgtatcttttagaccttctgcagagcgtacatacagtagtaacgcctcttcaaaaatatattctggcttttcgttaagcctatctattttccacgtttctgctttaagctgatcgtggtaatgttgagcttccttttttacagttgtgccagcagagcgtctaattctcttaccgcttggggttgtgatatcaacccaccatgggccatcttttgttcttctgtagatcgacatagtgttacctcttcgaccgacaaagctaatcggtcgctattatttgctcgttttttgagtaaatcaagatctgatttatggataagccaacgattagatcctttcattctaaaaaatccccagtcatagagatgatttctaaccgcactttgactaaggtttaagtgtttcgcgacttgttttatagtgagagtttcttccatatttcctccaaaaaataaaccctagcggtggctakggttgttttaaataatctactagtcgctccccaatccatcgcattacagggactgccattgagttaccgatagctttataacgtggactatyrgggcaatcatcaatckgtttgttgcgatatgggattrgtgtccaattatcaggaaaaccctgcaatctctcgcattcggttggagtgagcttgcgaataatagatggttggcaaatgcaaggtacattatttccacctgtcccmwttcttgcttttaatgttggtgatattggtttatctgcaattcgcacagcctcttcgcctttgacttcgaataacaccttatactgtgatgcagtcattgtaggtgcgataccaattcctayagtgtgatccttgtctttgcarattattgrtggatacgctccataagagcattcaccaatatttttggcagaacttttcycctcttcttggctctgattaaaatcccctcgcaagctcttttgctcaarragtatttgtgcgacacttcgccttctagcacttgccacaaggaacactcttttacgtcgttgggcaacgccgaagtattgagcattgaggactcgccaacagatagtacgggctgaatgcacataaccagagtttgtccatcttgcccctgatggctgtaatggctgacattcttgagccagtccagccaaaaggtgtccgaatgcgttgtccttggtagataagacaccttgtacattttcccagacgagcacgcaaggcggttgtccattttgatttctgacataatctattgcctctaaaatatggattaaagctaaagttaaatttcctctctcgtcatcaaggctttctcgcttgcccgcaaccgaaaatgcttggcaaggtgtacccccaactaacacgtcaggggctttgatttcacgatttaggattttttcaggcaaggcggtcatatcgcctagatttgggatttcagggtatcgataagcaagtaaagcggacgggaaaggttcaatttcagcaaaccataaaggcttgcctaagccttgccacgccacacttgctgcttcaattcctgaacaaattgagccgtaggtgaacattgttacttcaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataacctagcattcccgaacacatagacgtcgtcacgcacatgagcgtagccacgaacattagcattctctgttatccacgcacagtcacttataatagcgtcttcatagacttctgcgttatctcgtacgtaggtgtcatcacgtacaaccgcgttgtcatataccaaagccttgtcacataccacggcgttaccatgtattctagcgttaccgaatactctcgcattgccatacacytymgcattgtcrkacacccamgcrtyyccgtcrtgacttagattttcctctttctcaatrtaaccgcccagcttacccgcctttatatcaccaaaagagattaatgctttaattcggtagagtgttttaccattctgttgaatagtatcattttgaagaagttcgtattttttttgatcttgtttttcatattaaatttccttgtttgttaacgtcgtttgtcggattaattttttcaatcaactcatttccgaaataagctgatcgtagtatttttgtgcggcacttacgcgttcaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattgtgccttgatcactttttctatagcttgttgtcttgtttcgataatatccatcatcgcaccgctcccaagtgcgatatggtaatcttcgctattgtctaactcatcataaaattggctgtaaatttggctgtttggatcttgtagttccatcaaaacttcggtacgcactcgtttaaattccaaactatcctcaatgtcttcaccaaaatatgcttctgccatatggtcaaaatgtctatctaccgcttgaattaattgcatatcgttcattttttctttccttttaaaagtagcgtttttaatttttcaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttcgctcaccatcggcttgcaagtgcggtactctctcacatcatctacccaaacttccccataaaattttttactgattggattttgtaaaatttggattttgtagctattcatcttcatttcccctccttgtcatactgtgcttgtagttgttcggtgtatttttgcatgtagtctacatcggcttgggtaggcggtggcggtatrtcgcccttgcgtgaaatccattcaattcttgccatttcttcatcgtaagcaagttgtgcttcgggggagagttgtccgtattgagcaaacgctgggtgaaaataggcaaagacaagtagagtgctaagaaaaatagccacgataagaacgataaagccaagccatctgtaaaatgagattaataaattattcattttttgtttcctttttggtcaatttactgaatttaggttgagtgaaaccgccacactggaaaagtgcggtcggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatcagttccccctccaagcagattttatgaacatactccaccgcactttgtaatttatctgctgggatatcttcaatactttccacattcatatagtgatgaacgaggttataggcttcgctgtagagtaagccttttttgctaacgagcatatttacagcattgcgtaagccggtgcgttcattaacagtcgttttgcgttcggctttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagattttatttgtattaaacaagccactttcgacagtggcgtcgggaggttcgaaaacccgcaataaggcaagggctggacgtatttcctttcggtattgtattagtcgccctcccgacatagtcaggattacggatataaaaaaatcgcctagtggcgattagtaaactatccgccttattgcattaggtttcgacacctatgggcgaatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcccgactttctgttgaaagtgggtatatcctaaatsawwgggcggtggtttgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaataaaaaagcctgtgttgtaaacaggctattttgttattttcttttttgttttctaggtttatcgtatttaatcatttcacgatttgcaccttttagtgttttcttcacttctttaatattctgttcaagttcaagatgttcaggtgcaatcccactattttttatcatcatatcccgaacttctttaccaacttgagaagcggtattttgtaatgcatttaaaccacgtacattcttacttttaattcgttctgctgtttgagttactctaaaccagttacctgcaagttcagtatttcccataaagtcatataaagtccctttttcatcaggcatctgtttatgacgtttaagttcagctaagcccatattatacataccacggaatcccgcatctttaaaaagtccaaagtgttctggtaaaagcccggcacctttcgcagaagctgacataatttgttctccatcagctaattttttacggatttctaaacgctgaatagcgttatcatcaatcgcattttggactaatttatctgcaacagctgccaagattgtttttgcttgagcaacttgttcttttttagaatctgcgtgcattgtgataagaaagcacgcaaaacgagagagtttataacttttcacctctctaccttgaaagacaatgtcaatctgcgagaagttatccattatgtcaatttcaaggttggcacaagacgacatcgctttattgataacgcttttgaatgagttccaagactcgtaaccaagatgtagcataaaatcgtgggcgtgccagtatctaatgccattttggtgagcatcattttcaaagagttctaaatcaaattgttctgccattgtttacccctataaaaaaagccgttattgaacggcttgtagtgcggtcatcttaatccgaattcggggcggtgtcaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatcggacaataataggttttatccaaattgtatcgagatgaaatgaaagcaccttggggatttttagagtataatggatctaaccttgtgcttgctgatgatgttccggaaaacgttccttaaaattgattttttcatcaaatggaatttcttcgcacagctcaccatcataggtaacttgggacattgtcttgattttttctttggcttcttcggcattgttggcgtatacattacagcatcaacttgtgccttgtagctgatagcgaaaaaggtattttttcattattttttcttccttaggtattccttatgaaatttgaaacttacttagacaaacgccatgagtggcgttggcgtttaaaggcaagtaatggcaaaataattgcagatagcggtgaaggctataagcaacgttctgactgtttgcatgggatttatttggtacgacaaaccaatcagtttacagagattatttgtcttgaagacgataaacattaactccaaagctccgcaaagggcttttatttcatctcgatttttaacgagcgttccttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttattgatctgcaaagaaatttatttttgaaaaaaatgattgatcgcttgatttttgaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattaatccaaatgagaaacaaagtcaaagtcaaaatgcacgcattttggcgcatatgcaaaagggcgggcggattacttcgtttgaagcgttagctcgatttaattgtttgcgtttatctgctcgaattaaggatttacgtgattgtggtcacgaaatccatgcagaatttattgaagtgtctagtggcaaacgtgtgaaacagtattttatggaggcatttcatgagatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaacaataaaaaagatttaactaacgttaaatccaaaaaagccacaccaaaaccgaccgcacttgctttgcttgctgaatttggcattaccgatcagcttgctgaagattttattgaacagcgtaaagtcaagaaagcaccgattacccaaaccgttcttaaccgcttgcagactcaagccgatattgccaaattgccacttgtggaggtagtggcgattatgattgaccgcaactggactggctttaatgccaattgggattggaggggcgaaagccaattttcaggtaaagccgatccatcaagcaagcctaaattcagcgatgaaaacactacttggtggcaagggcgaaccattgaaatttatggagatacgctgtgaaaaccattgaaaatgcgaccgcacttattggcagtaacccgaattattctgcacctgtaacacaagggcaaaaacaggaaattcctgagcaagtagcgaagtatgttgaccgattatttgttcgtttaaaagccatttttccgggctggaaagcagcgtttaactctgatgcagagtacgaggaagcgaaggctacttggttgcaagcattggtgaataatgggattaccaaagcagaattatttaaacgtggtttgcagttagcagaacgctcagaaagtccatttttgccgagtgtcgggcaatttatttcttggtgtaaatcaggcaatgagtttgccgatgttggtttgcctagtccagaagagttgttgcaacgctatcacaaatttcgtgcgagttgtgaggagccggagaattatccttggcaaagtgcggcagaatttcacttagtttgtcagttaaaacgggcgatttatcaggagaatttaacccatgagaagttactgaacaaagctcagtcgttgattaaagccatggcaaaatatctcaaagaaggcggtcaattagcagcaccaaaggcaaaaaaattaaccgcaccgaaagaacaggttttatcccctgaagaatgtgcaaaagcctttgccgagatacgcaagcagttgtctagcgttacaaaaacggtttagtaggagatgataaaatgagttttgacaaagacgcttaccgcacgccaagttatgtttttaaatggctagaacgtcgtttttactggttccatttagacggctgtgcgaatgaacataatgccatgtgccatcgttggattggcaaaggtagtcacattgcagaagattttctggcagatgatttacttgatcgcttgattgatgaagtggttgaacagggggaactcttgcgaattttcgttaatccaccatacagtaatcctttgccgtttgtacaacgtgcggtagagctgatgaaagcgggttaccttgttgttatgttgttaccggcggataaatcgactaagtggtacaaagtcattcaggataatgcaacggaagttatcgatattatcggcggtcgaattaactttattcatcctgaaacaggtgaggaagtcaaaggcaataacaaaggctcaatggtggcagtgttcgatccgtttattcaaggatttgtaactcgtcaagtgagcttggattttgtgaaggagtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaccgcacttggaagtgcggtcggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggtgtagtcctgaatgcggggtgaaattagctcaaatggcattggtgaaatctcaagaaaaggagaagataaaaagggaaaaggaagaaagagcaaanattaaggcggttaaggagcggttaaaaagtcgaggtgaatggcttaaggatttgcaaggtgtatttaatcagtttatccgcttgcgagataaggatttaccttgtatttcatgtggtcgctatcatcaagggcaatggcacgctgggcattatcgtagtgttggtgcttgtcctgaattgcgatttgatgagatgaacgtccataagcaatgttctgtttgtaacaattataaaagcggtaatttgacggaatatcgtctcaatttgatcagaaaaattggcgaagaagaagttgaacgattggatagaaaagatcatccgccattaaaactctcagttgatgagattaagacgttaattaaggtttataaggcgaaggtaagggagttacagaatgcagcataatctacatgattttaagaaaaaatgcagacaatggggatattgggcaacacctagaattggtacggaatatccgagtatatcaccgtcaattccggttccgcaggataaatattgtggtaaagtcgatccaattaatgaagatcttgcaatggagtttgaacgttgtgtgttaattatgcaaaaggtaactcgagaactttacgatgttttcatggtgacttatgtttatcgcttgccgttgaggaatgaatatgacaggcggagaattttggtgagaaaagggatatgtgaaaccttggatataagcgaaaccacttataaaaaatatctttatacggctgaaacctcattaaagcttatgttaagtcaacatcagtgtatttttgttgcataaacctccctcaaggcggtttattcttaccacaaactcacaagctaacttacaagcagcttctcaacaattcgcaaacctatcaaaattagaccgcactttaaaaggctgaaaaaacaaaggggagcctgacgctccccactacacgattaaaccgacttgttatcgcccttgtttaatcgaccaactgtttttcaaattggttttacaagcccctttcgggtacagattggattttactttaattttaatgctaatgcagtacagtttttaatcacttggaaatcagtatcgctaacaagtggcgaaatataatcacgcttaccgattttataacgatctaatcgggaaatcgagacggtataaatcatatcgcatttcgcccagcactgaatgtttgctttatcaggcaatggattgacaggcaaagcatagtgatatttttctaagggttgaggttctgttgtactgagcggaataaccgtgactaattctttattccgtttatgttttgcaatgacgacaacaggacgaactttcgtcatttccggtgattgaaactttgagaaatcacacattagcaccgatttttcttttggttggtattttaggctcattgtatttttattgatatttttcatcgatcctacattaccgtaaaaagaagatcaacaggaagcaagccacgctttgaaaccgtggtaaaaatattagaagcctttaaccttaaattagtgccgacaataaaggcattgtaagttgataatgattaatttgcaaaaaaccttgcaaaagacgccgtaaaagtgtagtatttcagctatggtgcggttaagtacacttatagcataaataaacattttttacagccctgagcagacatgctcggggcttttttatgggatttttttggtgatttattatgaaagatatggggacgcaaagttatttgtggtcgggtctcagtgggtttatcgcttggctgggcgaccagcaaaatttgatgatgataagcctttctatcgggattgttaccgcttgtgtaaatctatatcaacggtacaaggaaagtaaacttcgtaagcgtgaaaacgaacgtgcggaagaattacatcgacttaaaatggcaagattacaaaaaggattagatgatgagtaagttggttaaagttggtggcatttgttcggtgtctgccattattgccttgatgatgttgaattttgctgacaattttcgcacaagccaacaagggcttgagttaataggacaggtagaaggctgtcgccgtgacccttatcattgcccttctgatgtgcttaccgtaggaattgggagtactgtggcaagtagcggggcaattgaaccgcataagcgttattcagatgcagaaattgcaaagcgttgggtaaacgatattcaagtagcagaacgttgtgtaaatcagttcgctaacggtcggctaatgcctcaatctgtttttgattcagtggtttcaattacgtttaatgttgggtgcggtaagttatctcgctcgaccatgtttcgtcaagcaaatgaaaaagattggagaggtgtttgtaatgaatttccaaaatgggtttatgcaggcggtaagcgattacgaggacttgaaatacgtagagagaaagagaaagcgttatgtttgtctggggtaaagcaactttaattgcgttattgggtattttgggcttgggtgttgcaatgtgggttcaggtacagcggattgatagcttaaaagccgacaacgcttctcaagcccaacttattattcgactgactgaacagctgaagatagagcaacaggcagtgcaaatacagcaaaagatagctaatcaatttaaagtaaagatggagcaaagcaatgaacagcttaagaatatcttgcaacaagagacctgtgcaaaagtggcattgcctcgtgatgttatcaatattattaaccaattgcacaacaccaccgcaaattgaatatctttctccaccacaagcctacactattccttgtgaacgttctgcttttcaggggaaaacttatggtgatgcaattaagcatttaatcaaagtaatggctgaacgggatttatgtgcaagtcagattgataagattcgggaatggcagattgagaatgcacagcattgagattttaatgttaatggtttaattatggcgaaaaaaaactggaaagcgttgcaaattgaatatctaaaagcaaatgcaaaaacaggtattactgttaaagattggtgcgagaagaaaggattaaagtttgccagtgcgaaacgttatataaaaaagcctgaaaccatgtttaatcagtctgaaagccgccaaacagtacgtaaagaaaaacaagcagaagcaataattcatcaagaaaactgcgaattaaattgcgaaacggacgaaaaaactgcgaaacgaaaacaacgctcttatgtgaattcgcagaccgctcgaaagcatggtggttatgctcgctatttcaaagacaaatctgcctttgatgttgtagtggattttagccttaaagatgaaattgatttaatgcgacagcgtgcggtcagtgcggttgaaagtatagaaaaattcaccgcacttttagccaatgccaacaccgcagaggaaaaatcactttatgcgaagctgattgagtccactgacaaagcacttgaaagagcggtcggtcgcattgagaatttaaatcacacggacaataacattgcaaatctcttaagccaaattgaattacgtaaggttcagtctaagaaagtaatggcggaaacagaaaaacttaagcaagagatgaatgcgaaaacagcgggacatcataagctcgaataccttcaggagtttaactaatgcgtattgtttatcgtgcttcagaaacgtttaaaaaagtacatgcctcaactgcgttggttaaagccattcgtggacctatcggtagcggtaagtccgtggggtgtgtgttggaaatgtttcgtgttgcacaacagcaagagccgaatgcacaaggcgtgcgaaaaactcgctgggcttgtgtgcgaaacacctatcctgaattaaagggaacggtgattaaaacctttcaaacgtggatacccgagcaaatttgcccgattaaatacgacagtccgattacaggtaagatgaatattaatcatcctgatgggaaaacacgtattgaagcggagtttttgtttctttcgatggataagccaaaagatgtgaagaaactaatgtcattggaattaactggtatttggatcaatgaagcacaatttttacctgtttcactggtaacagaagcggttacacgtactggtcgttatcctgaaaagcgggttgaagaagggtttatgggggcgacgtggaacggtatgattatggatactaactcgcccgatgatgaccattggtggtatcagtttgaacaagggattgatgaggaaactgaacagcctttaaagcctaaaggttgggagttttttgttcaacccggtgcattaattgatattacaggcatgcctttagcgacattgtcagatgaaataaaacgcaatattgaacaaggacattatgatgattatttaggacgtcgttttgtggcaaatcctaccgcagaaaatgtcattaatcataaaaaaggctatggctattggtttgataatattcaggggcaaacattaaactggatcaaatctcgagtgtgtaatgaatttgcaaccgttcaacaaggcaaacctgtttttggcgatcacttcaataaagaattacacgtttcaacagaaaaactggtaccggtcaaagggtgggaaacctttatcgggttggattttggtttaacacctgcggcgattatcggacaaattgcacccatcggacagttgcggattgtagatgaaattgtagcgacaggtatggggattgagcgttttattacggagcaattgtcgccactgttaagaagccgatatgcagagtgtgctattcaaatcataggcgatccggcaggtgttcagcgagcacaaactgatgaacgcacgtgttttcagttgcttgaggaatatggttttaatgctcgtcctgcagaaagtaataatacgacagcaagacttgaagcagtgcgttggtggttatcccgtttagtaggtaaaggtcagccggcaatgttgattagtccgcactgtaaaacattgattaaaggatatgaaaccggctatgcctatcgtcaattgaatgtgagcggtgaggaaaaatatactgaaacaccggataaaaatcggtattcacatccgcatgatgccaatcaatatctttgtttaggtgcaatgcctagcctttttaaagagcaggttatcaatattaaaacacatcaaccactaagcaatattacaggatattaacatgtcagaacaacttgcaaacgccattgaaagctatggacgaacacttcaaggcattttacaggagcaaattaaacaacgtcagcccatcgtgcaacgttggacgaaagatatgtatcaataccgcaatcaatatgaaagtagtattgatacagggaaatctaaagtctttgtgggatatacgagagcaaaaaccgatgcgtggtcggctcagatgacagatatgttatttccaagtgatgacaaaaactatggtatttcgccaacgccagtaccgcaaattgctcatcttgctaaacagcccgacagccaagatccaatgcaaatgcaacaaatcaacatggcaaaagagctaatgcaacaagccaaagagcggtcggaagctatggaaaaattgattgatgatcagctggcagaatgtgactatgcctctgaggctcgccttgccttgcattatgccgctgtacttggaacgggtattttgcgaggtccggtagtagakacaattgatgagcgtatttggtctgatgatggaatgggtaattggtccgcacaaaccaagtctaaaatagtgcctaaagtgcggttagtgttaccttgggattttgtgccggatatgaccgcacctacattaaaagactgccaatttgtctttgaacgttcttacctcactaaaaaacaattgcaaaatctgctgaataacccttattacttagccgatacggtgcaagccttaatcgaaagcgaggcaagcgaaacgcatacctccagcagtgatatggacggttatttagacacccttcgaaccttatccggtttagaaaaagcaagtaatgataaacggtatgaggtatggacttatcatggtggcattcctgtttctgtcttagagcaagctaatcaatctttagaagaaggctatgcgttggaattaacggaagagcaaaaatccgaaaaagcggaaattgacggcgtgattgtaatgaccggtaatggcaagattttaagtgtgaaccttaatccgcttgataccgcagagtttccttattcggtgtatacatgtgaacctgatgtcgcttgtgtatttggttttggtattccttatttgtgccgtgatgcacaggaaattcttaatactgcttggcgaggaatgatagacaatggtgtgttaacgattggatcgcaaattgtcgtcaatagttccgtactttcacctgtcgacaaaagctgggaaattaaaccgaataaattatggcgaaccaatgatagagcttctgctaatgcaagttttgaagctcaacgagcttttggcgtgtttaattttgaaagcagacaacaagagcttgctaacattatccaactggcgaaatcctttatggacgaggaaagcggtttgccaatgattgcacaaggtgaacaaggtcaagttacgcctacattgggtggcatgtcaatgctaatgaatgctgctaatgcggtacgcagaagacaagtgaaagaatgggacgaccaagtgaccaaaccgcttatccgccgtttctatgaatataatatggcgatggatgacgacccgaacatcaaaggcgatatgcaagtagtggcaagagggacgtccgccttgttggtcaaagaaacacaaacggcacagattattgatattttccaaaaattcggcaatcaccctcaattgtcttatgcgttcgattggtatgacggggcaaagaccttaatgcaatccatgagtatgggggcgaaaacgatgctgttatcaagggaagactatgagcagaagctccagcagatagaacaagcgaatgcgacgcaaccgcaagatccggaaattctcaaatctcaaatgcaaatgcagttagcacaacaaaagcaacagcatgaaatgcagcttgaacagatgaaattgcaacatgccatgcaaattgagcaaatgaaagtagccatcaaagagaaagagcttgaagtaaaaatgatggaaattgaaatgcgacaacatcaagagcaagaaagaatatcacttgatgaacgtatcaacagtgtcaaagtctcttccgatatgcaacgagaaaccagcaagcaaatgttagatatgaagaaattccaagcggaaattgctttaaaacaacaacctctcgccaatccaacaggaaactatggtgtagagtaattattgacattgtagaagttcagtaattccaaaaaaaacaaaccccaagtaacggctaattacttggggtttttcattccaaataaccagaatataaggaacgaagatttatggaaagtttaaaacttatcctatcaataatcaaggagtttagaaaaatgacagcacaactatccaatttacgcttttgggggctttggcttattggtttcttgattgcattatctatttttatcaatgcagtgaagtggtggtaacgtaattcccaaaaacaaaccccaagagccgcaaactcttggggtttttatttcccttaaccttaagcacacaaggaaaataatcattatgaattttaatatagagattggaaaaatgctagaaattattgcgaaataccccatagcagaacgctttgcttatgtatttactattttgttttttatctctgcggtattgtggctttcccccgattttttaaaagccctagcagattttatcttgacgatgaaaaatagttagagtagtatttacccatagagcttcaaaactcttttgtaacaatctaaaaaattcaatctatggacagggtggtgcggaaatatccaatacccacgccgtcgttacagcggttttgaacaccctgtccgcccacattctattcaaaaggaaatgtaacaatgtcaaattctactcatgtggtaaagccttaaacgaatggaaaggcaaaaagccggtattagaaggtgtgatccgcattatggaagataaaatgcaaattgaattaccgcttacagaactaccaaaactcacacaaatctaaccgcacaaagtgcggttagattttactggcagtcagtttgaatgccatatttttcagcgtaaagcaaaatagcctcagtaatcattgcattttgagcaagaccccgttcaaggctaattttttcgacgagatcgaaaatgtcttttttaattttaaaggatttggtttttacgccacgcttatcatcagagcgtttttgaatttcagcggttgactttgccataaatattctccataattaattttgaagaacgagagaggtttccccctctcgttgaattatcatcaaattagtacgctggcaggctaatgactaataagatgataactaggataatgtatttaaacattgtgttatcctcttcaaagttgggtggattgaaggtcgcacccagctcgtttccgcagtattgcgaaaacaagaatattataggtcgttttatatttctgatcaaggaataaaacgacctattttttatttgacttttaaaaatttcagtagtaatattcttctcaaggcgtcgaaacctaaacaaacagcggcaatccgcacccgacagcatagcggtttttttatgcgtaaaatttgtgatctgtttctttctctcaagaattttgattacgcatacccaaaatttatctatgtcgagagggcggagaatacaatacccgaaaggggaataatcccgaccgtctgtttgcggttttcgaacctctcggcaccctattgaatagggaaaactaaacttcgaaaaaacaaacaggagcagacttatgtctaatcaaattactactcaaactctttctttccatggttcagatcttattactctcaaagttgaaaatgttatctacaccgctattcgtccgattgtagaggcaatcggtttggactgggcaagccaatccgtaaaactaaacaaaaataaagaaaaattcgggtgttgtgatatcgcaacacctacaaatggcggattacaaaagatgatttgtatgccaatcaaaaaactcaacggctggctatttagcattaaccccgaaaaagtgcggtcagatttaaaagaaaaagtgatctgctaccaagaagaatgttttgaagcactctacaactactggcactttggcaaagccgaacgcaaaacgactgttaatgaacgcaccggcttacgcaatgctgtaaatatgctcgttagcaaaaaaggcttactctacagcgaagcctataacctcgttcatcactatatgaatgtggaaagtattgaagatatcccagcagataaattacaaagtgcggtggagtatgttcataaaatctgcttggagggggaactgattattgactcaccgaaacaagatgatgaccttgcagataatctaacgttaacctcaatgtggttcgcactttacaattgtttagatttgttagggcaaattgaacaacctttgcgagcaattggctcgcacttcggttcaacggcatacactcacgctacggaatatcgccatacattacaatttgcgagagatgtgctaatgcaaaaattagagggcgtagagattagctcttgggaagagccacactaccatttagcattgaaaacaatgcgagcaagagaatacccactgagaagaggtattaatagacgataatttagcaaaaattcacaaaccagaccgccaaaagtgcggtctttttttatttatttttaaggaaataccatgtcagactttagcctttccaatgaagaatttcagtatttgcaaaaaaacatattaggtatcgcaccaaatgcaacaggttcaagaggacgaggacaatcggatgttgcagatgagggttcttcgtccattgatgtcatagctaaccaatacaaattgccggaagagcaaggtttttttgccgatgtggttgatagcgttcaaatgggggcatggcgtggagcaggtgatttagcccgaggtataggagctttatttaacagtgaatggttaaacaaagcggctgattatgcctattacaacgcagaagaaaacaaagcgaccatgtcaagcaaaatgcaagaagccttggggcagagtgcatttgacggctggaatgaagaaactggagaaggcaaaggtttactcaatatgtattggtgggcgggcaatttgggagcattgctcggtgaaaacattgatacggttctcaccatgggagcgggtaaacttgcgacaacaggaataaaagcaggcggtaaacttgccggaaaatatttcagcaaagaagtcgcagaccaagtagggaaagcagcggtaaaacaagcaagccgtttcggtattcccgctcaataccacaaaaccattgcctacacggcgatcgcctctgctatgtcggcgggtaatcgtgcaaatcaagtccgagaggaattatcgcaaattagcgataatgacctagctcaacataatgactttcgtattgcgtattgggatttaaaagagagtgatgaagggcaaacactttccgaccatgaaatttttgaacaagcaagacagcagtattacaacaaggtcggacgagatgcgatactcaatcctcttgcgattgccgcagatattactgctaatgctgttggtggtttagggggtggtctttggggtctaccaaaggtaaataaatggctgggcaaaccgacacaaaatatcaaagagggtgtattaaaaggagcgttcattgaatctgcaacggaaggcttacaaggtgcggctgaacaatatgccatcaatgacacagcaagagattattacgatagtgaccgcagtttaactgagggcatgagtgaaaatattgctgatggcatggtattaggtgcagggttcgggggtatgacaggtggctatgaagctatgtctcatcgcagaaccatgaaccgtgagaaaaaacgccttttagaagcggtgaatacgggtgatgaacgagtggatgcacaaattcgttatcaagtagaagcctataacaaaattgccaatgatttagatgaactgatttcgccacaaagaatacaaacattaaatcaatttggcttacaagcggttgaaaaagcaagacgtagagaacaaattgaagcggaattaagaggggaaacacaagctcaagcagaaaaacaacaagcagagcaagttcaaacagtaaccgatacaccttaccatcaacgcaatttagccgatattcaggcggaatttatccagcatggtttagatgaaaatgattttaatgattttctagaagccaacttgcaacaagcgacagcagatttacaaaaacttcaagcaaacccatttaaaatggggacagatttgcaaaaaagtttagcggaaaagcaagcctataatgcaaaactggcggacacacaagcaagagtagactactggacacaggcaaaaaccgccccaaagtttggtactgaggctactcaagcagaaagtgcggttcaagcagagagtaaagttcaaacgcaagaacaagttacccctgatgaattgaaattaagccgttcagccccacaagaaacgcaatcattctacgaaaccgaacaaggattaagtgggaaagagggtgaatttagtgtaaacaatgatgatattcgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaataatcctgttgcagtaatgaagtctgaaacacagcctaacggctatgtggtactgaccgaattgatagagcaaatgaacgataaaaataaacctgtgattgcggcgttgcatttaaaacatagcaatcaaggcttagaattgattaacattgcgagcgtgtatggacgttctaattcacaaattcaacgtggattggaaaaagatttactgtattggaataaagaaaaaggnnnnnnnnnnnnnnnnnnnnnnnnnnnnnnnnnnnnnnnnnnnnnnnnnnnnnnnnnnnnnnnnnnnnnnnnnaatattaaaaccgaaactgacctaagtcaataccaannnnnnnnnnnnnnnnnnnnnnnnnnnnnnnnnnnnnnnnnnnnnnnnnnnnnnnnnnnnnnnnnnnnnnnnnnnnnnnnnnnnagctcatcgcctttatctagtatcaatgataaacgccttttgcagattttgcaacaacagactaaatctttcgactttagccaagaaaaatcccaaattgcagaagctgtaggaaaaggactatcaaccgcattttgaggtggtacattcttctgaattaggtattaacgacccgacaattgaagcggcttacaataccaaaacaggtaagattgttattattgccgacaatattcgagccaatgacattttaacacgtgaagagcgtttaaaatgggtagcgtggcatgaactggcacaccgaggactacaagtgcggttcggcaaagagttcaaagccttgatggaacaagcagaccgaaatacgacagttcgagatttagcaaccgcacttcaaaaagaccgagcggaacttcgagacaatcgcacgttggcggtagaagaagcgatagcagaactgcacgctgcttataccacaggcaaaatggaagagttaaaaagccgttatggtctagttgttcctcgtggtagagaaataagcctaaaatcttggtttagaattaccgctgaacgcattcgagagtttatggtaaaacttttcggacgtgaaaaagcaaatcgttttagtcatgatgacttgcttaatttgttgaaagacattcagcaaagtgcgggcggtgatatacacgaatcggataataatacacgttattccttaaatgaagatccaaattcaagttttgctaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgyttktctcgttcaagcacttatcaatcaggcgataatatttccgtattagaactttctcgtggtggaaatattcaagcaccgaaatggacggataagttcagcacgcttcaagccttgaaagaaacttttcatcaaggaacggcaaaattggacgaatggtttgctgatagcttaagaccggtaaatgattggatagacaacatgcagtttagcgatcataccagcaataaaagtggtcgagaccatgaaaaacgccgtttaaaagacgcaatgtatacagcaaaaggaagacgtgatgccttaaattccgagtttgaggttcattatttgaatccgattttgtcgaaaattgcagaaattgctaaacggtcgcagggtaaaatcaacgaagaaacggcaaaaagaaaagccggtttttgggtttcagcacgttattccattgaaaagaatatggagctattgagcattgatgaaaaagctatgcaagaagcacaaacggcgttaaatgaggctcaagtcaacggaacggctgaagatattcgcaaggcaaaaaatgcctttaattcagcacaaaaacactatcttgaccgtaaagcggcagtatggaataaagactttaacaacaagcactttaaagcaggagttgccggcggttggtctattcctgaagccaaagaaattatgcgtaatattgagcgtgatatttcgcttagggatttaacggcaattggtgatttaattgcggagttaaaccaagcacggttagaaattgattataagagcggtcgcttaacagacactgaatatcagcaatttaaagcgaaccgtcattatgtgccgttgacaggcgatccgaatgcacaattagacgacatggattttatcgcaggtgctggggcaaattcgttgaatattgccaaggataaaaccttaaaagggcggacaaattctgaggcggaagatgctattgacgcaatttggaaagcggtagggaaatcgacgacttatgcagggtggtctgaatttaaagggaaacttgatgagttacttgaaacggaagtgagtttgctagaacagcaaggctatagcaatgtggaagcacaacgcctagccggtcaaaatttagggattggcaaacagaaaatgcaaggactgacacgcagtagcgataatgtgttaattgcgagacgtggaggtgtgtattatgagtacagtttgccgagtaacgtcattgctgccctgaaaaatgataatgtggagcaggcaaatgatttcctgaaagtgttatctaagcctacccgttggtatgcaagaggagtaacgcagtggtcattggcatttgctccgattaatatgctgagggatacatgggaaaaatccgaatttattcgtgtgcaaaaagtatatgacagacaaggtaaattgctcagtagcgataaaatggatcaaatcggaagagcgactgcactttcacccctaacaaatcctgctatttggacagcaacgaaacgctttgcttttgggcaagaattgcgtgatagtgtgttagaagaaaagctattgaaacagctactcaaagaaggggcgatgtcaacatatggtacttatctcgaacgcacagaagcggatttactcaaacgcattaagcgagaaaatagcgtgctggggagtaaaatagacaaggcaatgggcgtgattgaaagttataatcaaactttcgatatggtttccgcactttctgcttacaaggcgttagtggataatggcgttgatagtaaacaagcagccgcaacaacattagaactgactaactttcgtaagacaggttcgaaaatgcgaggtattaaagccttgtatatgttctctcaacctacagtcatgggagcggcgaacttaattcgttatctttcaacgaagaaagggcaaatacgttttctgacgtataccgcaggaatgatggcactttatagcctcttgcgttctatggatgatgaggacgaggcggggaataaaatggatcagctgggtgatattacacgttttatccctattccaataggcaatggaaattatattaaacttcctgtggggtttggtatgcctcaaatggcgtggaattttgccacaaatattgtgaaaggtgcggtgtctgatatttcctttatggaagcgggggtgaatatggttacccatgccacaaaaacctttgcacctgtttcgccatcggagatttccgctgtgaaatacccgttggaaaaattggcactaacctttacgccaagtattttacaaccgcttatgcaaaatgcgttaaatcgttctgcttttggtagtcaaatcaccacaaattttgttcgccaagacaaactcaaagctgaacaatccaagtcgacgaccgcacaattttggaaagatttagcgattgatattcaacaaaccttaggtcttgatatgcaccctgaacaaattaagaatttgtttgatggatatagtggtatgttaggttcattgaaggagctgaatacgtggcttgtggaaaatccgaaccgtgagcaattggggcgtaacacgagaacattgttcattaatcagttgtatggtgcaggtaatgaatttgcggtgcaatctcgttattatgaagcgagcgaagaagcacaacaagttgctaaggagtatgcttatcgaaaactcaataaacaattggatagggaatggctaacgcctgaacgccaagagttaatcaaatggcatgagcataacttgcgaactatgggcaaattacgcagtgaaaaggcacaactcaccaaacagttaagagcgggaaaaattagtgcacatgcttatgagcaacgcctcaaacgctacaatgaagcggtaaactcggtacagaaaaaactgctgtcaggttatcgccaaatggtagggttaagcagttattgacctgtaaaaaaagcaaataaagcctgtgttaaacaggctttttcggcgtgtaataatgacttgctcatttctttttaatagattaaaatctataaaaaagataaataggcaatgtaatgcaacaagagtggaatgtgattttgcaagatcctgttttggagtggtttaaaacgctaaaacaagaggatttataaaacgatgatagcccttgctgaacaaacttatgaacactacctttcacaattagagcaggagtagcaaaatgagcaaaaactttaaagcattgatggcagaattaccgccggaacaacagaacaaggtgaaagaaatggctcaagaaatgagaatggagctacaactttatcgtattcgtgaagtgctggaaatctcacaacaacaaatcgcacaagcaatgaatatcaaacaaccctcagttgttgctttggagaaacgaggaaatgatgtgcggctttcatcggtgaaacgttatgtggaagccatgggtggagtgttgaatttatctgttcaacttccaacaggaaagacaatctcttttaacttgtagcattcataaagcgacataagatatagttgcctgatattttgcagaaattgccgagttatattttcaatgtaactcggttttttattggggaaaaacatgattaatttgtccagtgagcttgaaaaagagcaattaaacactttttttactcggcgagtaaaagaatatcaacaagatttaagtaacgagggattaaatgcccagcaatataatattttgcgagggcaaattaaagaattgcaggaattaatcgctttactaaatattcattcaaactgaacctacccaccaagtgcggtaggttttttatttttaaccattcaataagccgctttatgccgctttaggagaaaacaatggaaaatcaagaacaccatgagttcaacgaagatgccgcttttgatgaagccgcgaaatcgctcgaaacaggtgaactgactgctgacagtttgccatctgatgccgagaaaaccgaaaaggacaagcctgatcagcttgaatccgaacctgaacaacaagaaaaggttgaacaggacgatttgcccgattggttgcaatctgccacagatgaagtgaaagagaatttccgcaaattgcaagcagataaccaacgttaccaacatcaagcccgttcacaaaatgggcgtgttggggcgttgacaaagaaatatcagcaagcacaagctgaaatcgaacgcttaaaacaagagcattcatatgcaaaaccgcagttaaatgatgagttaaaggcgttagaagatgactatcctgaatttgctaaaatgttccgcaaatttgccgaacatcaagatagacagcttgctgaatatactcgaccgcttgaacagctagcacaagccgaaatgcaagatcttgctcaacaacaactggagaacagtatcaactatgttagccaaattgtgcctgatgcggagcaaattttaaacaatccgcattttgctacatggttacaacgccagccagtaggtattcaagccttgttcaattctgatgaagtggatgacgctatttatctgttgagtgaatacaaaaaaaacatttccgcaaatgaagttcgtaaagcaaaacaaaatcagcaactctccgccctttctttaccaagtgggcgaaccgttcctaaaggtggggaagaggtggacgaggatgtttatttcaatcagatcgccgcacaacttgacaagcagcggtctcgttattagttcatcttaaaagaggaaaaattttatgaccacaattacaaaatattctgatattagcccacgtactacagtgtatgcagcagctcaaatgcttaatcatgcagagccgattttggtgttaaacaaattggggcaaactaagcctattccaaaaaacaaaagtcaaaccatcaaattccgtcgtcctaagccatttgctaccgcacttgctgcattaacggaaggtgtacgccctactcagcaaaaaatggcgtatgaagatgtcgaggtgtccttgaaacaatatggtgcatggacggaaattaccgatgtrattgaagatacrcacgaagatccggtgttaaaagacattactatgctttccggtgaacaagcggcggaaactgccgaaatgttgacatggggtatyttgaaagcrggaacaaatgtgatttattcaactggtacagmaacaaryacrgtaaaagatgtaktaagyattaatcacattcgtgctgcggtgcgtaaattacagaaaaaccgtgcgaagaaaaaaacctccattttagatgcgtctattaaatatggtacgaaaccgattgaggcatcttatattgcggtttgtcatactgacttggaggcggatattcgtgcacttgccggttttacaccggtggctgaatatggttctcgttcaccgattgttccgcaagagtttggtacggtagaaaatattcgtttcattacctcgccattgtttaccccacaagaagatgcgggagcasaktcaatcgakgtagtatcgaaaagcggttcaaaagctgacgtgtataacattgttatctttggtcaagacgcctttgctacctgtccgttaaaaggcaaggaatcggcagatatgctgattcgcaatccgggtaaacctgaaaaaggcgatgagttrggrcaaaccggctcggtgggttggaaaatgtggtgggcaggaaaagtcctcaatgaggcttggctcgtccgtattgaatgtgccgctaaaaaactttaacccaattatcacaagtagccccatgtaaaagtggggctttattctttatgaggaaattattatgtcttatccatttatttcatttaattcgacagtagaacaattaaaaacacatttacgtgaacactgcggtatygaaaaaagcggtagcaaaaaagaactaattgaagcaattttagcgtttgaagaggaaaacggattcgtgcgtccaaataaagacgtggcagagcataccgctcctgtgaataaccttgaattacctttagaaaagcaacgaaaagtgcggattaaaattgcagaaaccgagcaagatcgcagtgatgtttatgtgtctattaatgattgggacgcattgattaaacgaggtgtagaagttgttgtgcctgaggcggtgtatgttttattatcaaaagctggcgatcaaacctttaagcaagaaaaagacggctcactgacggaaggtttcagtcctcgctatcatgtgactttattgggttatgaatcatgaattttttagcgttggctcaacgtttacgccaagaaatgaatgattccggtgaaggacctgcacaagtaacgggacaacgagggcgaaatttagagtatgtgaatgcgataaaagaagcatggcttgatatacaacaatgtcgcccttgggctgtttctttttggcaacaaggctttagccctgataaattacagatacttgaaaacactgttgatacgccgttcattcctgcacaatatcatcttgcaatcgtattttatgcgatgcaatccaaagccatttcacaaaatgcacaagaattgatattgcgaggacagcaagaatgggacaaatatctccatttactttgtcgggactttttgccgacgttgaaagtaggtaggtagacaagctatgttgattattttagaatagccatattattccattttatttgaggtttttatgtcgaatcctaatgctccctacattcgggaaattgttgatcgctcacgcctaattggtggaacagcgatccaatctcaacggaaagatgacgtaaaaaaagccgttttacaggtattttctcaacaggctyaacgcttaaactaatttgtcaaaaaamcccgacttgttcggggttttttmttgcctattttcaggagttccaatgaaactaccgcaaattcaatcacwgtttgttgcgataagtgggggtatggatttaaccacaccgcccattgttaaagcaaatagtgaagctattattgcgttaaatgtacaacctaattacggtggcggattttctcgtattgagggrtatgaatgtttagacggtatgactaccccctctttaatgaaccattttcatgtgaacgttaatcacgatgttccacaaagtgcggtcggaaaacagtttttgttaaatgaccgcacttgttatgtgttagcagtgaatgaacgttgtttaacctttgccgtttcgggacagtttgaggttgatgtcggtacaacctttgaccttgataggcaaacctatcaaaccatctcaaagacttttttgaatrcaggagaggycaaacaatggcaacattaccaagcactggcgtttcaagcgggagtggacaatgtgcaagcggtaccgggtgaaaatgccttgcgtggtgttgttgaacttaacgagcaaattatcgcatttcgagatggrgaaaatgcttgtgaggtttttttagcgaccaaaacaggttggcaatctgcacctgccacttattttgttgagcttaaagacatcagcaagccaaaagaatttattgacggtgtgaagtttacttccggggaaaaacaaggaaacgtcttttctgccgtgttgtcggctgatgatagtagcggttatcttgtggtcaatactgctcttttacccgaggcggaaattcatattaatggtagtgttgcggctaaggtgaaaagctgtgaagcggtgaaattgacaaagggaaaggcgtggacatttatttatcataatttttatggtgggacagaaacggcttatgcttacggttgtaacggtgagcaggtaattgaagttcgtcctgatggtattatcgtaccgattataacccaagcggaaaatcctcaatatattgttgcacatcgtaaccatttatttatcgcctttccagggggacaattcgggcattctttagtgggcaaacctacgcattgggcagtattgctcgggtcggaacattttggtgtaggcgatgaaatcacagcactgtcttctaccacagggggcgtactgttaatcggttgtcgccataaaaccaccgcactttatggctcaacacgtgatgactgggtattaaaagatattgccaaggtggggattaaatcaggtacgctacaagcaacctttattccgattgccattagtcgacatggtattattcgtgtcgatgcaacggagcaatttggcgattttaaattaagtgaaacagactccggtcgcaaattgggtttcaaacccattgaaaataatattgtcttttcttccacaaaagccaaatcaaaccaagtgcggttttattcggagaatgcgtttcatatttgcatgatgttacaaccggacggcagtacaaaaagcacctatttcacttatcccgaaaaactaaaaggcgtatggcaatctcatcayaatacgtttttagcttttgatgacggcaaagtctatcgtcaatcggatgactgtttttcttttgcaggcaagccgattgaatggacagtgaaaatggcatttaatcactgcggttcgcctgtgcatattaagagctggaaaagtgcggagttacaagctaccgcacagggtgttttgtctgtgcaatatcgtttcgatttggattataacgctgattttcatgcagtaaatcttgcacgggagttatctgttatcggtcatggtggacgttggaacgaaagttattggaacgactttttatggtctactcaggaatattctacccccgtactttatttatcgggttacagtcgaaacctatctttatcttttgccggttcggatttatacgcccctcaatttgaactgagcggcttagtgttaaactatattttaaggagatttcatcgtgtctaaaaaattaagaaattggtacaaaagaactcatgattttgcaccctatactcgtgctgayggaaaagcrgtatcrgatgaatttgatgcaatccaagcgagttttgaaaaaatgccmgctatgcgagatgacggactgggctttgaagaaagtccggttattcccgacccgacacaggataaccaccctgtacccttacatttgttaaaaacggcggaacaatcggtttatgcggcgagggataaagtcacggagcttgctcaacaagttgcagacaataacgcaacaacggagcaaaatacycgyttagctatycaakccaatgaacaagcccaacaagccaaaacagaggcragccaatcygccacacaagcgattgacgccaacaaccaagctcaacaagttaaaacggcagtacaaaaagcgaaagagaccgcagtttcttcaatgcaatctgcggaacaatcaaaaaatcaagcaatacaagcggaaaatttagcgaaaaaatgggcgtccaatcctcaaaaccaaatagtacaagaggggaaatactctgcttaycattaygctctagaagcagaaaaayacgccgaaaaagtcaaagcgaccgcagarggacgtaaagattggmawtttattgataaygtccctatcagcaaagatattaacgayagctcagagacaaawttagccagtgctttttcggtyaaaaccgcctatgacaaagcggttgaagcggaaaaaatagckaatggcaaaagcaattttaaaatagaacaaggcaaagacaacgcagacgactacaaaaccgacgggcaytattattttgcgagcggtcagmatttgcccgataacggwgcrtggcatgttgaagtggtgagcggtgggcaarctaccgccgtgcgacaaattgcacgcaaagcsaaygatacmrrmgtcaaaacwcgsttttttaryggytcaaawtggacagcgtgggaagatttgaatgtttcgggtttatttacctatgaaaaaacaggtaattatgagaattatatagaagtccgccaatacccagatggaactatgatacaaacaggtagagcttcgttgatatatacgcataaaacatattttttatacaaaaaagtcttttttcatgttgcgtttagtgagccaccgttaatcttcaccagcctagtcaagccgaattctgaaaaatatcaaatctaccgtaaagatgaattaaatgtaaatgttatctcaacgaagattaatgaaacaggatttggaatcaatttagttgatgatgacgttcatgattcagaccccgaaataaaagttgactttatggcgattggacgttggaaaccgagccaatttagtttctaaaaatccaattgcgtcgcatgaattcctaaagcaagggcgattttttcccttgtggctttacgcaagtgagatgatttttcatattgactatatgcagattgagtaatatttaaacggcttgccatgtctttttgcgttaatcctaaatgctcacgccatgcaacaagtgcggagcaattattttctaaggcaaaagtcgccacagcaaaaggcacgccactatctaaaggagaggaaagttttgcttgttgttttaaccattcaagggtagcgatgggcatgacggcaaaagcagggtgtccgctttcatcatgtaaatattgaatgttagtaagtgcgttcatctcgttttttcacctcttcaatggaaataatattcatcatatcgccggcaatttcaaagaaaactcggtaatcgccgaccctaaaacgataggggtaacgatgattaacaagggcttttacattagaacaaaaaggaaaatgcgttaattcttggcattttcgtgcaattttcgcccctgttggaatttttcttaattgctttaacgctttgggttggaaaataaccgacttcatgaataaagaatataagttaaatataagtttattttagcaaaaacaacaaccaaggacaacacatgaaaatctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcacatttaacccaagtgcgggcggaaatgcgagagaaaatcaatgccttgcgagatgaaaaaatcaatggcggggtgtttgtggargcggtgggcaagtggattgatacggacgctacggcggagcggaatatcttatccgtcaaagccagttatgatttattcggtgatatggaaattgcgtggacttgtgcggataacactgtwttgatgattaacaaagaaaaattaatgctgatttggcargcsttaatgmatgcyaaracmrgyaatcaygcyaatgcsttraarcataaaamcgcyrtrrascaatcggacaatccggcggaatatgattattcsrrcgggtggacaaaatgctatcaggattatttaaaggagcagaatgatgagtaaattaaaatattggttttatcatgttttaattgccgttgaccaattactcaatgctgtttttggcggtgcrgcwgatgaaacmttttcaagycgttgytatcgtggkgcggtgttggyaaagaaaccgaaaaaacgttggcgagtgatrcaytttrttattgagggsmttttcttttgggaaaaggggsarcattgcaaaattgcctatcaatcggaattggaacgcaagcaatattcagcggaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttctacaaaaagaggacaaataatgggtattttaaattcgatgagtgaggggttgcaaaaccccaagcaaaaaccgcttrcacaaggcactrcgaccgcacaacctcaaaacactagccaatcagtrccatcaatggcacagaatgtaacgaacaaccttaacagtaaytcgttattaatgaaaagtgcggcacaaaaaggcaatcgaatggcggcacaaagaggattgcaaaattcaaccatagggattgagtctgctcaacgtgckatgcttgatgcggcratkccgatagctcaacaagatacgcaaaatcagcaacaaataaccgtagcaaacttgaacgctaaactttcacatgataacgcaatgaaagagttgggtgctcaagtgtcggcgaatacaatcggcaaatctattgattatgcaatgcaaattacaaataactttgacgctcaaattgcyggtgtgctgaataatacrcaratgaaagaggaggataagaaaaaagccattgarcaattgaaagcaagtcgwgatacggaattgagttttatgagtarrttyatgcaaaaaattccgacsacacaaaaagattgggcggcattcccgtcattgggcgtaccgacaatcacaatgaaaccaacagaaacagggggtaaagtatgagtttttgggattcagcttggagcgtaattacagagtctgccaaatggatggaaaaaaaccaagcggcaacaaatttaatgggaagtgtactacaaggaactgcgggctattttcttcaaaaagagcaarmtaaaaatywaatgcgacaacarmgwgarttgctkaatttgaaagatgaaatgcaatcaaaatattctgcggtrccggaagtagactcaggttatggtgggcttgtggttgatgagacacctaatttggcgaatggcggtattttaactgaaatgaaaaaaaaggtagatagaaaaggagtgtagccatgggatttataaatgatgccggcggtggtacagctagaaatattcgcgatatagatagrgacagagatagaggkcgyaataatagctatgatacgmaaagtwtggayaatttagctaaagctattcaygacggmtcttaymaaggwaaaaatgatagcagatggtctcgtcgagrmaaggacggytatagttcattcggtmgmsatagggataatgaaaagtatagcaactatgccggcagttattctaaaggaaaaagtgcgattggaagtgcggtacaaaaccatcgaaatktagtrgctaattctccgtccgatctcaaatcaaaaacgctaacgggtgaaaatgttgatgatggtttgttgtcctcaaaccaaaataagcaatatagtccaattgactatgctgaaatgtataaaaacggacctcgtcatccgatagaaaaagcaacgttgggtaagcgagaaatgggaccgatgagccgaattgcacctgaagatccacatgctaacagctatcaaaactacagatatgtacaatccttagcgaataaggattggatagaagatacgcaacgaagcatagccggaaatgcggttggcggaatatcttcctccggagtggctaatgcggttgccggtgctgtagggggcggcttaggcagggctgtagccggagcagtagcgggaatagcagcatctaatgccggagatttggctaatatggcagtaggtaaagccaacaaagaaggattaacagatgaacaaaaagcaatgtacgatcaagytttctcacagagaaaggattatttcgacaagagaagacgttcatttgatagtttcggtaatggtatagcgactgttcttggcaccggtgtcgatattgcttcaaaagggytaaccatgggggcaggctctaccatcgctgatgcctacaaaaataattcggcattggagaaaaccttggaaaattttgatagccctgaaaataggcaatttttaaaagaaagacaggaggcgtacaagcgtgcaagggaagaagatgcgaaaagacgcaaagcagatgggtcaaataaaggcattctctacaatatgactaaacgtctacagcctcaagaagagccacaagagccaactttaccttactatgctattccggcattaactaatctttggaataacgtcattgtgaaataaacaacaggagaaaactcaatgggtattttagataatatggcacaacaagccaatgcacaaccgcaaatgcaacaaacggcgacactaccacaaactgaacaaacgggaaatatgatgcaaatgtatcaattcttaatgcaaaactcaatgcaagccatcgcagaaacggcagagcaacgcattcacgaaaaaggaccggtagacggaacggcagatttaattgcaaccgcaatggtttcaaatcttcaagcggcacaacaaaatggtaaaaccatccccccacaagtcatgttacaggtcgccaaagatattgccatgcagttattacaacaaatgggcgtaccggaagagcaacttgatgatgtattgattgacgttttatttaaagcgttggatcaatttggtgaaatgagccatggcatgttatcagcggaagaagagcaacaatatgtygayatgatcaacaaaatatctgmkgcggaacarcaacgycaagcacaaaaaggcgaaaatccgaccgcacttgaacaggcacaaacgggaggtatgtaatgggatttggcggtattttagcctcaattgctcatggattgggcggaggtatgattaaagtcgcggatgagggctggaaaaaagargcagacgagcgtaaaaatcaattctatgcagatcaaaaagcattagatcgagaggctgaactaattctattagacagaaaacatcaaaatgacattaattttttgcataagaaaaatgcgatttctcaagcggttaacaatagccctaatatgaaagcgatgaatgaaatcaaagacgcttttgatgcaatggacgcaggaaacaaagaaattgcacgacttgatgaaytattagcggayaaatcactttccaaagagcaacgagaaaaacttacawcgcagagacarkcaatttacgatcatrtttcttcrgtagccaacaacraagaaatttggaaaggaattsatarwggcagatatggtcaagcaatackcrgcaaacatattcaaatgactrcaccatacaaaaagacaccatctccagtggctgtttcgcaaaagcaagcyaaccagcctataattgtaccaaaacctgacaaagctcagttatacggagaagatattatgaggagataccacaatggagaattactagactagcaaaaactctaaaaacaaaccgctctttggattgaattgaagagcgrttagaatttattttgtaagctgtatctttgcaagatgtaatggtagttaatgagatgtgaaaatgtgacataaatgtgtcataaaaggtgaaaaaagatagtaaaaggcgtgttttttataggagggtgttctttgattagctttgtaagtctttgttttaaatgttgtttttgttttatttggtttttattaattgctcttctaagccgtaggtcattggttcgaatccaaatagggcgtgccatttcttaaattcctctaacaaccaaccaactacagctccaatgatctaaactaacgacagcttaaaaaacaagtattttttgctatctcaaaacaaagtattgtatttatatacagtataaattatgatctaaaaaaaccgattacagaatttaactgttaccaaaaactgatccaaaaacaaaaaaagtgtaccaaacagcagaattaaaacccaagccatgtttaaaaaaatcacccaagcaaggcacatgaagttacgccgccaaaaagacggtatagaactagggtttagcggaaataccgcctacatcgccactattcatcaatatggattaagagcaagagtagaacgacacaaagaacacaaagtacaatacgccaagcgtgaattactaggccttacagagcaggataaagaaatgattgaagcgtttgtgattaaggcattgagtgaaaatattgattagatgtcatcatctaaattcttatttttgcagtggcaacaatttttatcacaattggacgtatcataaaacaacacaaaaataaaaaataaagcaacactgccaaaaataaatgtcagcccaacgcttaaatcaaaataaaaataacaaataaggtaaggacatgcgacaattaacacaaaaataaggtcaataaaatcattaacagtcaatttacttttcatagaaccaccgtagtttttgtcgttattgtctttttatattaaaaaatagcaaataaccgcaataagaatgatggcacttatgccccattcaaggctaaattgataatcgacctgttctttagcatgataacgtccggatttcttttgaattgccattagcactgtatccaaaagtaacatcaaaggcgttaatgcaaacgtgaataacacgcaacctataccgacagggatagaaagcaaaaaaacggaagtaagcaaggaactgaaaaaatgaatgacagataaggtttcccaactcatccttagcgaaataccaaacaacacaataacggtaaacatagcactgatgtagtacaaatgagtaacccaaaaaaaagtaaaattttcatactttaattcatcgtgtcgcataaaaacccctgtgttttttgtgtatctttgtttattttttctacgttgtcaatcttatttaaacacattaataaattgttctcgagatcggacccactcataaatcactgacaaaaatagttttggtcagcattgccggttgattatcatccatatcagcaaataatgtggcaagtttttgctgtgctgtgtcataatcaccttggcttaatgcgttggtcaccggattcaatattgggttcattaattgttgatatttctccggtgtcggttctaatccgtctcacacttcatcaggatcattttgtaccgataataacgctattttccctttgcctatcttttgaaccgacaaaagtgcggtcatatttggcggtgttttacgctctaatacagcttcgttttctgttacggtacttgcagtttattcgtataaactttgttgatgttcatcaggtctggttttaaatcggcgatgtaaccacatatattgtgttacatcttgcaatatttccttttctacaatcttattcattcgtgtcgctattgccgtttcatcatggagaatatccgaaaaatcaacaggtgctgaaatgttcaacgtatatccagagttatctttgttacgaagcggtgtaaaagggataactttgctcttaggtgatgattttattaagtagtaacttccggttgtcgttgccgcctccggtacagcaaaaaaaggtacgaaaacagcattttttcttccataatcatgatccggagcgtaccaaatcatttcaccatgacgaatagctttaatcattgcacgtaaatctttgcgatccaataaacctttatttgatcttgcacgtccacggcattgtaaccaatccattaaaggattatcatgcggtcgataaatgccaatgcctggatgagatagaccaataatccttgcacctaattctaaagtgagaaaatgaatacctacaagaataataccgtcttgttgattttcttttaaatattcaagcccttcaattttgctccatttttttattcgtttatctgaccaaaaccaagccataccggtttcaataattgccatgcctgttgctttaagattggattgtaatatatcgttgatttcctgttcagaataatgaggaaaacagagctgtaaattttggcgagcgatttttgttctgcgttgaccgattttcaaacgagaaaataaagaacctaaaccgttgccgattttaagtaagattgggtaggggagcaataaaataagacgaaaaaataaaaaacctaaccagaaaagccagtatttaggcttaagaaattcaatattaaattgtggaattgatgtttttgccataatgttacttagtctaatacaactttgattttgcgttgtagtttaacggaaatttgacgaaatagcatttttactgtggtaaaattagcaaaattttagtgattttatgagagaaaagaaaaatgatgcaatattcagcacagtttaatcgagctaaagtactggtgctcggtgatgtcatgcttgatcgttattggtttggggcaaccaatcgaatttcacctgaagctccggttcctgtggttagagtacaagaaaatgaggaaagagcaggcggtgcggctaatgttgctatgaatattgcctcgttaaatgtacctgttcggttattgggtttaacaggaaaagatgaagcagctagggcattaatgcagctattggaaaaacaaagtattcattgcgactttactcaacttgactcgcacccaactattactaaattacgtatcctatcacgtcatcaacaattattacgccttgattttgaagaggatttcaacaatataacaagtgcggatttattgtgtaagcttgaaagtgcggtacgaaattatggtgcattaattttatctgattacggcaaagggacattaaatgatgtacaaaaaatgatccaaattgctcgtaaagtaaatattcctgtcctgattgatccgaaaggaacggattttgcacgttatcgcagtgcgacgttattgacgccaaatatgtctgaatttgaagcggtagtgggtaaatgtcatagtgaagaagaaattgcagagaagggcttgcagctaatcaaagagcttgatttatccgctttgctggttactcgttcagaaaaaggaatgacattattacgtccaaacaatgcaccatttcatttacctacggaagcaaaagaagtgtttgatgttaccggtgcgggcgataccgtaattagcgtattagcaaccgcacttgctgacgggcgtagttatgaggaggcttgttatttagcgaatgtggcggcagggattgttgttggcaaattgggtacatcaacagtttcaacagttgagttagaaaatgccattcatggcagaactacggcaggttttggcattatggaagaaagtcaattaaaagcggcggtggaattggcaaaagcacgaggagaaaaaatagtgatgacaaacggttgctttgatattttacatccggggcatgtgtcttatttagaaaatgcacgtaaattaggtgatcgtttaattgtcgctgttaatacggacaattctgtaaaacgtcttaaaggtgaaactcgtccgattaatgatttagcgactagaatggctgttttggcgggattatcttctgtggattggcttgttgcgtttgatgaagatacacctcaacgtttaattgcagaaatattacctgatttattagtcaaaggtggagattacaagcctgaggaaatcgttggcagcaaagaagtctggctaaatggtggcgaggtcaaggtgttaaattttgaaaatggctgttctacaacgaatgtgattaaaaaaattcaacagttaaaagagtaagggaacattatgattacggtatatggtattaaaaattgcgatactgttaaaaaagcattgaaatggttagcagataacaatattgaataccaacttcacgattttcgtgtagacggtttacaacaatattggctagaacaagcggaacagcaatttggctgggaaaatttagtcaacaaacgtagtacgacatggcgtaatttagatgaagaaatcaaacaaaatctgactaaacagaccgcacttaaaaccttacttgcacaacctactttagttaaacgtccgattattttacaagatggcaaagcgttgattgggtttagtgtagaagattatgaacgtgtattgaaataaaagatcaacaacgttctatttaacgtatgacatattgcaatagtgcaaaatgaaactatgaattgataaaaggacagatgctacgcaaacgttcgtaaaaaaataaaatcttatgaaaaataacataattactctcactcaaagtcttattcaacgtccttcaattagccctgatgatcaaggctgtcaacaacttattgccgaacgtttacaggcggttggttttaagttggagtggttaccttttggtgataccttaaatttatgggctactcatggtgaaggaaaatgtattgcttttgcggggcatacagacgttgttccgattggtaatgaaagtcaatggacttatccgccttttgaagcccgaattgttgaaaatatgctgtatgggcgtggtgctgcggatatgaaaggtgctttggcagcaatggttattgcggcggaaacttttgtgaaacacctgccaaatcatcagggaaaaatagccttgttgattacctctgatgaagaggcagcggctaccaatggaacggtaaaagtagtggaaacgctaataaaacgtaacgaaaagattgactattgtgtagtaggtgaaccttccagtgcaacgcaatttggcgacattattaaaaacggacgacgtggttctattacaggaaatttgtatattcaaggtgtacaaggtcatgtggcttatcctcatttagcggataatcctgttcataatgccttgaaattcttagatgaattaactcattatcaatgggataaaggtaatgaatttttcccgccgaccagtttacaaatcgccaatattcatgcagggacaggtagtaataatgtaatccccggtgaactttatgtgcaatttaacttgcgttattgtactgaggtgacagatgaaattattaaaactaaagtggctgagatgttggaaaagcataagttaacgtaccgtatagactggaatttatcgggcaaaccgtttttaacacctcaaggaaaattagtaaatgccacagtggaagcagtagaaaaatttactcaaatcagaccgcacttagatacaggaggaggtacttctgatgctcgttttattgccacaatgggagcggaagtcgtggagtttggacctcttaatcaaaccattcataaagtgaatgaatgcgtgaatattgatgatttagccaagtgcggtgagatttattattatattttggaaaaattgtttaatgaacaataagttatcaaaaatcctcacaggaaaaagtcgtgaacatttaatttcattaccgaatacgctttcggctaatcattttttgcagatggaagttgtcgctgcttttttgcagttacagcaagctgcaaagcaagctggctttaatttacagccagtaagtagttttcgtgattttgaacgtcagcgtttaatttggaatacaaaattttatggggaacgtaaagttcatgatgatcaaggaaagccgctagatttgaccgcacttgacgattggcaaaaggcacaagcgattttgcgttggtctgcgatgcctggagcaagtcgccatcattggggaacggaaatcgatatttttgatcctgatttattgccaaaaggacaatctttacaacttgagccttgggaatatcaaactggtggttattttcaacgcttaactaattggttattagttaatgcacaacaatttggtttttattttccattttttgagttaaaagataaaaaagtgggcaatgaactttggcatttaagctattttcccattgcagatatatatcaacaacaattttgccctgagtttttatcacaagcgtggtacgaggaaaacgttgcgggtagcgagatattattgaagcatcttgatgaaatatttagggattttttgatttaatgatttaagctatttttagccaatccaatttttcataattttagaggtatatatggaagttcagcaatttactcagcaagatattgaaattcttcatgaagaaacattgtacaaaggtttttttcaattaaaacgcattcaatttaagcataaactgtttgctggtggtgtgagtgaagttgtaactcgtgaattactttataagggagcagcatcagcagttattgcgtatgatccatatttagataaggtgattttagtcgaacaagttcgcattggtgcttacgatcccaaattaaccacatcaccttggttatttgaattaattgcaggtatggtggaagagggagaaaaacctgaagaggttgcactaagagaaagtcaagaagaagcaggcgttcaagtagataatttgcaacatgttttaagtgtgtgggatagtccgggcggagtgattgagcgtatccatttgtttgccggaaaagttgatagtacaaaagcgaaaggtattcatggcttggcggaagaaaatgaagatattcaggtgcatgttattagcagagaaattgcctatcaatgggtctgcgagggaaaaattgataatggtatagcggtcatgggattgcaatggttacaactcaattataaaactttgcaacaacaatggttataaaatgtgatacagattatattttttataaaaaattagataaaaatatgatcctgttaacattttcattatttttttaatgcaattttttattaaaacagtaagttataacccgtttgttgtatataaagggtgaatattttgatcagtacatatcaataccctacttcagagaaagtagttcgtttaattcagattaccgatccccatttatttaaagaaaaaaatggagaattacttggtattaatacgtatgatagttttaatcaagtattaagcgaggttttacaaagtaaatttgattatgagcttgttttagcaacgggagatttagtacaagatagcagtgaagaaggttatcaatattttgctgaatcggttaagttgttgaataaaaaagttttttggattccgggaaatcatgattttcaacctaaaatgtttgatgttttaagtcaatatcaagaatatatttatccgacaaaacatgtattagtgggaaaaaattggcaaattttgatgttggatagtcaagtatcaggcgtacctcatgggtatctaggacaatatcaattggattggttgtcagcaaaactgagagattatccaaaacgccatgccttagttgttctacatcatcatattgtttccactaattcggcttggttggatcaacataatttacgcaattccttagacttaatgcaagtgttgttaccttttagaaaagtgcggggcattttatatgggcatattcatcaagcaatggatacaaaatggcagggatataaaattatggcaacgccttctacatgtattcaatttaaacctgacagtaatcatttttctttagacacatcacaaccgggttggcgtgaaattgagttatatgatgatggacgaattgaaacaagggtcaagcggattcaacagaccagttttctgccgaatatgttgagtgagggctattgatgaaaagcgaaaagtgcggtgaaatttttgattttttcaccgcactttgttgttcaagtcatcacaaataacattcgctagaatttcatttctaatgataaagcaaaattacgtccagcagcagtaaagcgttctaacccttttccgctgttatatacgtcgcccaatgcaccattctctttgatttgtcgtaatgtatcccaagtggtgtacttacgattgaataaattaaagatgcctgcatttaaggtaaaatgggaattgaggcgatattgtgcggttaaatcaaatacgacataagaactgcttaaaaaacgataaggtttgggttgcctaaagtcggatacaacacctgtttttttatcaacatccaattgcaagctatttacattcggaatatcaatagcatctttagcttttttagcactgacatatcgcccgctgaagagaacattccatttgtcgttatccgcttggtagcctaatcccaacgtcgtgctaaaaggctggattggtaacattgccgtgccattatttttacgtccttttgcatagcttgcttttaatatagcgtaccaagatttggataaaccaattattttcccgttagcacgggcatggaaatcaagaccggtaacataggctttatcaatatttatctgctgataatttacgccatctaaataatattcagtatatttttttcttggcttggttgcccagtcaattttttgacgagatccgactttcggttttgtttcgacatcaataaaatcccgatattttgtataaaatacagccaagcttaattggtagttgtcgccttccgtggtaagagaaagttcatgattttgtgctttttcaggcttcaaattaatattaggtaaagatatgacatcacttgccccttttaaatcaaaatacatttcttctattttcggtgctttaaaacctgtgctgaattcatagctaagtaacgtggaatcagtgatcgaataatttaatcccaacgaaaaattgaccgcactaaattgtttcttgggtaaaacttcgactttttgactggtgagatcatattttaatgcacttgtggtcggtttatagcgatagtgatcgaagcgtattcctgcatttgccccccatttttgattaatactgattaaatcctgcacataagcgtaccaagcttgacgagcaacaggttgttgaacagtaaattcacgttgttttatccttgaataggcattatactcttgattcctattttctaatttaccccaatgataacccaatccacctgataattgatgacgagcaaacttgccggcaatttcattggcaataaaagaaacatctaattgataatgcttctgttctgttttatataaacgcttgtcagtaataatattataatcttgcggagaaacaccatattgattggaattagcctgttgtgagactttttgttgggctaattgtacgctaaatttatttagccagctttccgttggggtataattataggaaagaccaaatcgctgataaggtgttatatcgcccgcttcttgacgatttgaagcataaaaacttttttctaaaatttttctgctttgctcaagattttcaaaaaaaccttgcacaaaatgttgtggagtaaaatgatatcctaattttgccaaccaagatcggctgtgataatccacattatcaggtaatacacgactacgcccacataattggggaaagatatctcgctggtctccatttggtaaaatgccacaatacgcaacgtcttttagtttgccactgtagtaatttttgttttcatgtgcatggcgataggtgtattgcaacaatccctcggcgttaccctgcttgaacccccccctatcacttggcgatattccgtattacgtgagctataggcagttttagcataaaatccaacagttttattcgagtctacaaaatcatgcacattttttgttcgcatcgacacgctaccgcctaacgcaccgctaccttgtgttaaagaattcgcccctttattaaattctacactacttaagttttcaatttccgtgctgttgcgattaccattataaaatcctttaatatagtaaaagcgaggcatataactttcgaccgcacttattccatcaacactcatcgccacacggtcgctttctacaccacgcatagtataaccattggcaccgccacgccctccttcagtgactgtaacacctgtttgccaacggaccaaatcctgttcgttccataccaaacctcgactaatttgttggctatttgtgcttgaagttttagccgatacttgttctgtttcaacaataatctgatctaatgtagcagaatcattaaattgagcgattgcattaaatgaaaataaaggtaacgtaacagcagaaaaccgcagtaacgtttgctgacgattttgatcaaaaaacataacacccctcttaaaaataagaatcaatcttattaatgataacagagatattactatatcgctattccttcttttatttatctaattggagaaatagaaacctttaaaatagcagaaatataaaattagacctttttcttactaatggtatctatccatactgctagtaataaaatgccaccttttacaatatattgccaaaaagtcggtacatccagcatactcattccgttatccaataaggcgatgataaatgccccgattactacgccaaaaatactgccgataccgccggctaaactggctccaccgataacacaagcagcaatggcatcgagttctgcattttgaccggcagatggagctccggctcccaaacgggaacttaaaattaagccggctattgccactaataagccgttaagagcaaaaatggttaatttaactttttccacggcaatacctgataggcgagctgcatcaatattgccaccaattgcgtaaatatgtcgaccaaatgctgtttttttcgaaatgaatgttcctataatggctaatccacagagaattaatactggaattggcatgcctcgataatcgttaagcagataaattgcaccaagaataaggattgctatcatgccatatttcactgtttctttgggcattttggcaactggtaaatttaggttttgtctggctttacgctgataacttccccaagcaataaagcaaaatattatgatgctccctaaaattatccctatggtgtcggaaagataaccttgaccgataattgtcatatcattactgataggggaaacggtagtaccattcgttaatccgatcaaaattccccgaaatgcaagcattcctgctaaggtaacgatgaaagatggtactttttgataagcaacccaccaaccgctccacgccccgattagtaaacctaagagcaaggtaacaaggatagttaagggtaacggccaaccccaccaaacattactaattgccgcaaagccaccgagtagccccattagtgaaccaactgataagtcaatttctgcagagataatcacaaacaccataccaatagcaagaataccggtgatagcagtttgacgtaataagttagagatatttcttgcacttaaataagccccttctgttgcaattgagaaaaaaaacataatcaccataatggcaatcagcataatatagacttgtaaattgattgatttgaacttattcatagcttactccttaagtgcggcttccattacttgttcttgagtgagatgatggttgattaaatccgctttaactttaccttggtgcattactaatacacgatcgcttattcctaaaacctcaggtagctctgaggaaattacaataattgacatcccttcctgagctagttggttgattaatttatagatttcatattttgcaccgacatcaatacctcgagtcggttcatctaaaatcaaaatgttaggatgtaataatagacattttgctaaaattgctttttgctgattacctccacttagccggcctattgcgagttcaggcgaggaagttttcactttcagtttggcaatagattgattgataatggtttcttccagcggttcgttaatgacttttttaccaaagcagaattgagacaaagaagataaggtaatatttttacctacgctcataataggaataataccgtgttttttacgatcttccggtaccatgacaatatgatttgcgatagcttccgcacacttgttgattttaactttttggttattgagaaaaatgttaccttggtattttcctacataagaaccaaaaatacattgagccatttcagttcgccctgaaccgactaatcctgcaacaccaagaatttctcctttccgtaatatgaaattggcattatcaacgcgtttaatatgtgtattggttgggtgccacgcagttaaattttctacgcgtaaaatttctttgccaatatcgtgtggctcgtgtggatacaatgaggtaatttcacgtcctaccatcatggtaataatgtcatcttcgcttatcccttgtgctaattgagtgccgatgtgttcaccgtctcgaattacacagatcttatcagaaattgcttttacttcatttaatttatgagaaatatagatacatgcgatattgtgagcttgtagacctttaatcagattaagtagaatgtctgtttctttttcggttaatgaggcggtcggttcatctaaaatcaataaacgaacttgtttattcaaggctttagcaatttcaactaattgttgttgtcctaatcccaatgcactcacttttgtatttggatcaatatcgagctgaacctgctctaataaggttttacaacgcagatacattttgttgtcattagtaataccgacttgggtaatttcattccctaaaaacatattttccaatactgacatatttttcactaaagtcagttcttggtgaataatcgaaattcctttttcttccgtatctttaatatttttagcggttaatttttcaccggaaaaataaatttctccctcataatcccctgagggataaataccacataatactttcattaaggttgatttgcctgagccattttcaccacatagagagagtatttcgccggtttcaagggaaattgaaatattatttaatgccacaacatcaccaaattttttagtgatattcttcatctctaataatttcgtcataacttcacccctttttttagtatggcaagacataaaatcttgccacataaaatattttattatttataaacagcctctttggtatggaaaccatctttaatcaccgtgtcatcaatattctcttttgtaacgacgacaggctctaataggaatgcagggacatttttcaatccgttatttaattgagagttggattccacttttccacctttacctaacgcgactgaaatttcggctgctttatctgctaaattagtgattggtttgtatacggtcattgtttgtgaaccgtcaagaatgcgtttgattgccgctaaatcagcatcttgacctgaaatcgctactttgcctgataagccttgagcacttaatgcttgaattgcaccaccggcagttgcatcgttagaagcgactaccgcatcaatattgtttttgtttgcagttaacgcattttccataatttgtaatgctttttcagctagccaagaatcaacccattgatcgcctaccacgttgatttcaccactgtcaatgtgcggttgtaatactttcatttgacctttacgaaataattttgcgttattatcaacaggtgaaccgcccattaagaaataattccctttcggttttttctcaataatgctttgtgcttgtagttcacctactttttcattatcgaacgaaacatagaaatcaatatctgcgttattgatcagacggtcataagctaaaactttaaccccctcttttttggcttcagcgatcacgtttgacaatacttcgccattgaatggaataatcactagcacatcaatatctttatttagcatattctcaatttgagaaatttgagctgtcgcatcaccatttgcagattgaacgaatacttttgcacctaaagcttctgcttttttcacaaaaatatctcggtctttttgccatctttctaaacgtaaatcatcaattgacataccgattttcagatcgtttgctagcactgaatggctaaaaaccattaaagttgctgttgcgaccgctaataacttagatttaagtttcataaaatacctcacttggttgagagaatgatgtaagggtataatgtagttgccccgagtgaagtctgcggagatttggtaataagtgcaattatcagatttattaatgtaattatgttttttcgcttttgtgatctgttcgacattaaccaataatctaaatacaaaaacgaaatatcgtaattgagggttgttttcaattttaagatgatgagccttgtattcatatttatcacatctcagaggagacttggctatgtctaattattttgacaaaattgcaaaggtaaattacgaaggagcaaattccactaatcctttcgcttttaaacactacaatccaaatgaagttattttaggtaaaacagtagaggaacacttgcgtctggcagtctgctattggcacacgttctgctggacaggtaacgatatgttcggtgccggttcattggatcgtagttggcaaaaaacaggtgatttgctggttggtgcaaaacaaaaagcagaaattgcttttgaatttttccaaaaattaggtgtgccttattatagttttcacgatgtagatattgctcctgaaagcgataatttcaaagaatatttacataacttcaatactattgtggatattttagagaaaaaacaatcagaaactggtgtgaagttgttatggggaacagcaaactgctttactaatcctcgttatatgtcaggggcttctaccaaccctaatccggaagtatttgcttgggcagcagcacaagtttttactgcaatgaatgcaactcaacgcttagggggtgaaaactatgtattatggggcggacgagaaggttatgaaacattgctgaataccgatctcaaacgtgaacgtgaacaaattggtcgttttatgcaattagtggtagaacataaatataaaatcggctttcaaggtacattactaattgaaccgaaaccacaagagccaactaaacatcagtacgattatgatgttgcaacagtttatggttttttaaaacaattcggattagaaaatgaaattaaagtgaatattgaagctaaccatgcaaccttagcagggcatacattccaacatgaaattgcaacggcaacttcattaggcattttcggttctattgatgctaaccgtggcgatccgcaattaggctgggataccgaccaattcccgaacagcgtggaagaaaatacgttggcaatgtatgaaatcctaaaagcgggtggtttcaccacaggcggtttcaactttgatgcgaaaattcgtcgccaaagtaccgacccatatgatttatttcatgcccatatcggtgcaatggatgtgttagctttgtcgctcaaacgtgctgcaaaaatgattgaagaccaaacgttacaaaaagtggtcgataaccgctatgctggttgggatcaagagctgggtcagaaaattctaaatggcaaagcgagcttggaggatcttgctaaaatagtagaaactcaagggttagatccaaaacctgtttcagggcagcaagaatatttagaaaatttagtgaatagctatctttatcgttaattctgacaagcggtctttttttgcaaaattttgcataaaatgaccgctctttagattaaggagtatttatgtacattggaattgatcttggtacttctggggttaaagttgttttacttgatgaaaatcaaaaaattattgccattactcaaaaatctcttcctatttctcgccctcaacccttatggtctgaacaaaatccacaagattggtggaatgccactcacgaagcaatgcttgaattagctgataagcaaaatttaagccatgtaaaagctattggattaactgggcaaatgcacggtgctacattactggataaggcagataacatactttctccggcaattttatggaacgatggacggagctttgctgaatgcgaagagttggaaaaattagtgtcaaatagtcgtgaaattacaggtaatttaatgatgccaggctttactgcacctaaattatgttggcttaaaaaacatcagcccgatattgccaaaaaagttagtaaggttttgttaccaaaagattatttacgatttttaatgacgggagaatacgcttctgatatgtctgatgcctcaggcacaatgtggctggacataggtaaacggagttggaatgaagcacttttgaatgcttgtggacttgatttgaataatatgccgaaattatttgaaggtaatcaaatcacaggttatttacgcaaagaaattgcacaacaatggaaaataaatgccgtacctgttgtggcaggtggcggtgataatgcagccggtgccattggtataggactttaccaagcagagcaagcaatgttgtcactcggtacttcaggtgtgtattttgtagtaagtgatacattccgtgccaatccacaaaaagcagttcatagtttttgccacgcactgcccgatcgctggcacttaatgtcggtgattttaagtgcagcctcggctgttgattgggctgcaaaatccctaggctttaaagatgtaccaaccttatttcaacgagttgaagcaagccaaaccgagtccaatgtcatattcctgccttatttatcaggcgaacgtacaccgcataatgatccttatgcgaaaggtgtattttggggattaagccatagcgataatcaagttacgatggcaaaagccgtcatcgaaggcgtgagttttgctatggcagagagtattgatgttttacatgaaacaggtgttactgcaaataatattgcgcttattggtggtggagcaaaaagtgcttattggcgacaattacttgctgatattagcggtaaaacatttgaatatcgtacaggtggagatgttggcccagcgttaggtgcggctaaattagcacaaattgcattaaatccagaacaagatattgcgaatttctgccgaccgttaccattggaaaaaatctatcagcccaattctgctcgctatgcagaatatcaagctaaacgtgagaaattcgcagagctttatcaacgagtaaaaggtctacctttgttttctttgtaaatcaaagacatataaggcttttcttgatctaaaagtgcggtgagaataccgcacttttaggggtatattttggatacaaaaaaacggcgataacaacactgctatcgctggtttagttttatataataaattagttaaacacaccgctgatgccgacacggaaacctatkcgaccacggctgtcggaggacataccgccggagacagcccatttaccatttttggaagttctgccgaggtttaaagagaccgcactttcgctgctataangagcggcaccggcggcataagaccatttwcccgggacgaaaggsacktctttraaagccatmgcrgcggcgataccggctttrgcgtctttgttgacytcttcaasacgttggttrgtkgcgtgtaattgrctrccgtttaccgcatcrgtkgakygatgagaaagcaaacctgcrgcaacattttgaatacggcgttcattgcctttgytgccyacggaaacgaygcctttagcgtcagcaccggcataattgccgtcractttaccgataccgcctgaarywtcgctttgggcggtatatctggaaccatcgcctagaaacacagaattatcagtggtaacatcaatattattacctatggcaactgttttggtgccgttattcttaatattacgacccattgagaaagaattatctttggttgtatgtacaccrctaccaaaacttagtgaaccttcgcctgaggctgttgcttgcggaccgatggcttgcgatcgtttaccactagcagttgcttgccaaccaagtgcggtagaggcttctcccttcgcattagcagcccaaccaaatgcagtactatattcaccctctgctttagctcttgcaccaaatgccgaagataatttgcttgctactgcttcatcacctactgctactgcaaaatttccagttgctttagaatctttacctatagaaattgcctgcgtacctgcatttgcttggaagcccattgctacggcataagattgtgcctttgctttcttaccaaccgcagttgctccttcatgtgcagcatttgcttcaaagcctacagcgacaccagactcagctactttggcatcttttccaacggcaacggatttggtaccayyagtataakttccttctgccttagtaccttcaccaatataaacatgcccattactaatatgattattaccactatttgattgttgagcttgagccatagccgaatgagcagttaaarcaactaccgcagttaaagataaataaaaaattttcacttaaaagaaatccttaaaaaaagagttaacatagaaaaatcataaaaaarctaaccgcactaagaggcgataatttatgacamkmmtwaaaaagaggtagggggayctaccaaagcgggcgarattttaagcggggggggggtactgtcaatatatttttttacaaaatrtttacktwtttaacaaaattgaaacggtaaaaaacatttgtcgaacacggaaaaatattcatttgtttttgtgttatggaatgcagtagaaagaagaaatgaagttgcgtaagtgatttaaacgctccacgcattttcatctagtacttgtccaaaatgactttcaacgaggcgtttggttatatcgctttgtggttgggtaaagattgtttttgtatcgccatattcgatcatttgtccttcgtccatcactaatacatgatcggctatgtgtttgatgatgcctaaatgttgacctacataaatataagagatgctgagtttctcttgaatgtctaacatcaaatttattaattgagttttgactgtcgcatcaagtgagccgagagcatcatcggtaataataatttccggtccaagaataagtgcacgcgcaatagcaacgcgttgtttttgaccgatggacatggtattaatttttacattggcatgttcgggataaagtcccactaaacgtaatgtttcagctattttaagattacgttcattttcgtttaggttggttgtcaggcgtagaggtgcatctaaaatttgtcctacatttaaacgaggattaaaggcagaataggggtcttgaaagaccatgcgaatatgttgtgaacgatattgataatctccgtactctaagggatttcctttaaatagaagttcgccagatgtgggttttataataccaacgatcattttggcaacagttgattttccggagccatttttaccgataatagccaatgttttttttcgtgccaaaacgaaactaatattttctacagctttaaattggcttgtgctgaagataccaatattatcattaaaaaattttgataaacctgaaacttccagtaagttcatttttacttcccgttcttattttgttgtgtttacgactaatgggccagtttccatttctttttctctacgttgactttcttttaaattaatagggaaatggcagaaaaattcatgttgtttaatccgttgtgcggttggttttcgaatacattctttttgtgcaaaaggacaacgtggacctaaacggcaaccgataggcattccttctaataatggaacagtaccttttagcgtactcaaacgacttttatgtactaagggctgtttaaaatcaggaatagaatgtaataatgctcttgtatagggatggtgaggattttctaaaatgttttctttagatcctgattcagcgttttgtccgcaataaagaactgaaaaactatcacaccatgcactaatactatttatatcattacttaccagcagaatacttgttccctgattttgattcatactggcaagtaaacgaaatatttgtacttttgtcattgactcaagagaatttgtaggttcatcagcgattaataatcgaggttggtttgcaattgcaagggcaatcataattttttgtccttcaccttcagttacttcatgtgggtaactttgcataatatctttatgatctttcacacctacacgatgtaataattcaatagcacgacgttttttccaaccgaaccattgccaccatcgccctttaaatgtccaagagggaatgctctgaataagttgttgtccaatttttcggctaggatctaaagatgctaaaggctcttggtaaatcatggagatttctttacctaccagtttacgtctttttttgggatttagttttagtagttctacatcgtcaaaacgaaaacgatcggctgtaataatccaagaatccttaattgcattacaaataactttagcaatcaggctttttccggaacctgattcaccgactaaaccacagatttcaccttcatttaaggttaaattaacattatcaataattttgaatcgtccttttggtgtttctatttcaatacaaagattacgaatatcaagtaaagccatgtcggttgtccttatccataatatttttctatggctttacaaagcccattagtcaaaatgagaacgataacaatggtgatgataatagcaacaccgggtaagattgttgcccaaggggcaagataaattaattctatataatcttttatcattgttccccattctggcgttggtcgttgtgcacccaacgaaataaaacttaatgcactaatatcaataatggcaatgataaatgctctgctggtttcatgaatataacgaataataatattaggtaaaatggtttcttttacaagttgccaattacttgcaccatcaagtcgcagcatcaaaatgtattcttttttcagttcttgttgtaccgcttggtaaatttcatgaataaaatagggaagtaatgcaagcgtgatggcaagcattgcattgattaagcttggttgcattaatgtagcgataataatagcgatgagtaaaatagggattgataagaaaatatcaaaaaaatgtcctaagactcttgcttttaacccttgtgataatcctgcccaaataccaagaattccacccaaaatagatgtgaataatacaacaatgagggcggcaccaaaagtgtaagttgtacctcgaatcaaacgactaaaaatatctcgtccaatatcatcagttccgaaaaaataggcaatttttccgttatcagcccaagagggggggagtaactcaaaaccaataaactgtgctgtatcactataaggtgcgataaattgactgaaaagtgcggtaataatgagtaataaaaaaagataaaagccagttaatgccaatttatcttggtagaaaaatttccaaatatgttttaatccttgtgtttcgcgaaattcttcaggttctttatctagcataccagttcttcttattaaatgggtccaaaataaaggataagaattcagtaaataaattcactgcaataatacaaagcccaacaacaataatgcctattgaaatgctattatagtcttgttgtttaaccgaatctattaaccaatgacctataccaaaccaaccgaacgtgctttcaatcagcatacattgagccataacaagagtaaataaacgactcatttgcgggatcatgataggtattgtgttacgtaaaatgtagatttgtagaatttttctttttgaccaccctcttgtttctgcaattttgacataactttgggtgaataaaaaatcagctcgttgctgaacgattctaataatatccatagttggtagaattgcgagaactaatgtgggcaacacaagatgttgcaaaacattttgaatcattttaatacgataaggctgatccgtaaaccaaacatcaataataggaaagcctgtaatgggctttatctcatacaataaattatactgtccaattgctgaaatttcccaattttgaatagctgaaaagtacaacaagattggtgctaaccaaaaaacggggatagcaatacctgtgatatagaaagaacgaatagctttgccacacaaatgatctgcatataatgcactgagtaatccaagaggaataccgaaaattaatgctaacagcattgcactaacacatagctctaatgtaggaggaagtacagcaaaaatcaattcttttagtgattctccgccgtggtaagtaataccaaaatccccttgtagtaaattttgtagatagaaaaaataccctgaaaaaaagtgcggtgttgctagcacttgatttaatggatctttgagcaggatgctgtaactgatgagagataaaataaacagcgtgctgataactaaaatgcagtgacgaaaaaaggaaaatagcattgttttattacctgtttataatttctattattttttaaatgacagttttgaaaaattaatattgccaaacggcgttaattcaattccctgtacttttgcatttgctaacagaacacgttttacgttagcaataggaagaatagggatttcggataaaataatttcttgtgcgatattataatattttgcacgttcacgtaagttcgatgcggctaatgcttgatctaaggcgtgttcaaaaggtgcatggcaccaatttgaaaaattagttatttcgttttgtgtaccgcaacttaaaatgggacgcataaaactatcagggtctagatttcctgctaaccagccagttaagataatatcgtaatcctcagtttgttcttgaagctgttgcattaaataagtgcgggtaacgttacgtatatttacattcaccccaaccttaattaaatctgctttaattaattcagccatttttattggcgaagggttatacacttgttcttcattaataacccacatatctagatttatattttttcctgcaaagtattcctttgcttttttgacattatagtcataggcaaaatcagttgtatttacaactgccccccaagatattgatggaataatattgttcgcaacacttgctgtattatgataaatcaggttaataatacgttggcggttaattgcatgagcaatatggcgacgaatctccagatcttgcataagtgttttttgaaagttaaatgcgatataagataaattcatgccttcaattgattttatataatatttttcatcattgtgacgcaataaccctaattggctcagttccggataagaggcgatatggcattcattattgaagaatttaattaatctgcctgagcgattagtggaaagatcaatgatcacgttttccaggtttacatttttttgccaataattagggttatgaacaagacgaacatattgattacgaaagtaatctttaacctgataaggacctgtgccgacaggtaaattatctaattgcactaaattgtcgtctgcattgagttgcaatgcgtattcttgagaaaaaataatggcgtattggctggctaggtgagaaagcacggaagcatcgggtttaaacaagataatttgaatttggtaaggattgattgctttcacttcctgaattttttcatttaatttaatgctgtcaaaataaggaaaatgcacttttttacgttgttcgtgatagaccttatattgtggatttttatagtgaagagtgttttgatctaattccggtagtgcgatattctgaccgagtatgcgatttaatgaaaaaaccacatcttccgcattaaaatcacggcttggtgtaaaccagtctgtatgatgaaatttaacgcctttgcgtaaattaattgtaataattttcccatcaggtgagatactataggattttgccaaaactggttcaagagttgcactatgatttttaatttcaaataatttattgtaaatttgctccgtgactatattcatactggttccggcatctgcagtttgaggattaaaggaaaaactgcttgcattggtacaataaatcaaaccgttgtcagtgagtattttgggtattttgggtgcactaaaagagggtaaactaaagagtagcccatagaagagtgtacataatataaaaatcttttttgccaacataacttaattaattatgataaattatatgggaattgtaaggcatattaacgcaatatagaaataaaaatgtttaattttatccataaagaacttgatgaactcattaatcgtggaatggaccgcactttacgcattgccgttacagggctgagtcgtagcggtaaaactgcttttattacaagttttattaatcagctattacatattaattccattgacaataaacatattccgctatttttacctgcacaaaataaccgtcttcttggtgtaaaacgtgttgaacaacgagatctcagtgttcctcgttttgactatgaacaaaatatgaaagcgttaaagcgtgagcctgcaagttggtttaaatcaacggagagtgtcagtgaaacacgtttagccattcgttatatacgtaaagatggcttaatgcgacatttaaaagaaaaaggcacattatatgtagaaatttttgattatccgggtgaatggttactggatctgcccttactggatttggattttcaacaatggtctttacagcaacaagagttatttattgagcaacgacaagaattagcacaaaactggctgaataagatccgcactttagatttaagtgagccggcaaatgaagagatgttggcacaacttgcccaagactatactgaattcttatttgcttgtaaaaaacagggatttcatttaacacaaccgggacgctttgtgctacccggtgaattaaaaggcgctccggtattacaattttttcctctggttcatttaactgagcaagagtggaaaagactaaaagagcggtctaaatctgacagttattttgcgatgttgagcaagcgttatcattattatcaacaaaaaatagtgaaaggtttttatcaagaatatttttctacttttgatcgtcaggtgattttagcggattgcttaacaccacttaatcatggtcgccaagcgtttcaggatatgcaaaatgctttacagcaactattcaaaaatttccattatggcaagcgaactttattcaatcgtttgttttcgccaaaaattgataaattaatgtttattgcgaccaaagcggatcacattacattggagcaatttccgaatttagtgagtttaatgcgtcaattagtacaagagggagggcgttacgtagaatatgaaggaatagatactgaatatactgcaatttccgccattcgttctactcaacaagtacaagtaacgcaaaatggacaaaagatcaaagcattacaaggaattagatcaatagataagaaaaaaattgttgtatatcccggaagtgtaccgagtaaattgcctcatgcagacttttggcagaagtatcattttgcgtttgatcaattcgaacctcttacagtggaaaatggtgagccaatcgcccatttacgtatggatgctgtcttacaatttttattagcagacaagttagattaggatataaatatgcaaaaaaaggtttttcaacaagaagatgttgagcaaaaaatcacagaaaattttgagcctaaacaagaatttgagcaagacgaattagatatagaaatggactgctctcaatctgaaacaacaatggatcggcaaaatacagatattcattttcagcatatggttagaccaaaattgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggagcaataataaaagaatggcgacgtttagttcaactaaaaaagcgtttgatattacaagaaaaaagccgagaaattcgctcaaaaagtgcggttaatttaactgatgtttcttctgagggcaaagagttgtgtttaaaaattgcctcacttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtagatatgttctttatcgcttggcgtaatattcgtttgattaatcaattagcaaaactttatggtattgagttgggctatgttagtcgtctccgtttgttacgcatggtttttgttaatatggcatttgccggtgcggcagaagtcattcaagatttcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtagaaataatttattagcttcaaaaagcaaagattatatacataaaatctgcactttaataagtctgtcaaactgttagagtgcagattaaaatgaccaatttttactcttaagcgacaacattaaattgtgctttcatcaatgcttcgaaatctgtgcaaccgccaataggtttttcatcaatgaaaatttgcggcacagtttctaccggtttaccgacagacaatgatagatccgctttactaataccttcagcaacaatatcaatataacgataatcgaagtcttcaagggtattttttaatttttccgctaagttttttgcacgaacacaatacgggcaacctgaacgaccaaaaataacaacgtacatatttattttcctttttgttttgttaataaaaaagtagcgatattctaactcatttggtacaagatttttagcattgttacaacgaaaaaagcctatttctatcaatatcagaaattattcctaactatcaataagttcaatagtcacaccgttatgtaatcctctcggcagaggcgatcctttgcgtcctcgctcagcacgaaatttttgtatatcctccggttttaaggtgacttttcgttttccagcatgaaagacaagactggttttttcgctgatcaagaataatttgaccaataattctgaccgctctttagcatttgcagcgggaatatgaatgattttgttgcctttacctttggataattcaggtaagtcggcaacaggaaaaaccagcattctattcatggaagttaaagcgaccaaaagtgcggtagaattttgcaaaactaatggaggtagtacgttggcattttccggtagggaaataaccgcttttcctgccttattgcgagataccaaatcttcaaatttacaaataaatccatatcctgcatcagatgccataagcaaagattgattttcgttttctatcagtaaatgttcaatagtagcaccgctaggtaaggtcaattttcctgtaagcggttctccctgtgatcgggcagaaggtaaggaaagcggatctaaagtgtagctacgtcctgtgctatcaataaagaccaccggctgattgcttttaccgcaggcatgggtcaaatagttatcaccggtcttgtagctcaaagctcgtgcattaatatcatgtccctttgcacaacgtacccaacccatttccgataagataattgtaatcggttcgctcggtgtcatatctgtttcagaaattgcttttgcctcagcacgttctactaaaggcgataggcgagggcttgcgaaagttttcgcatcttgctgaatttcttttttaattaaattatttaagcgaatttcagagtttaatatttgctctaaactgttccgttcttttgctaaattatttttttcagcttgcaattcttgttcttctaatctggctaaatggcgtaagcgtaaatttaaaatcgcttctgcttgttcatctgttaaattaaagcgtgcgatcaatatttctttaggcttatcctcattacggataatttcaataatctcatcaatatttaaaaaagcgatgagtaagccttctaaaatgcgtaaacgagctaacactttatctaaacggtattgtaagcggcgagtcaccgtttgacgacggaaggttagccattccgttagaatttgaacaagattttttaccgcgggtttattgtccaagccaatcatgttcatattaacacgataacttttttctaaatcagttgtggcaaataaatgtgccataagtgaatctgtatcaactcgatttgatcgaggaacaatcaccagtctaattggattttcatgatccgcttcatcacgaatatcttctaccattggcaattttttattctgcatctgctcggcaatttgtgccacaactcttgacggcgaggactggtgaggaagtgcggtaataattatttcaccattttcttttttccagacggctcgcattttgattgagccacggccttgttcatatattttacgaatatcttctttcggtgaaataatttccgcttcagtcggaaaatcaggaccttgtagcacggtcattaattgatccaaagttgcattaggattatctaacagcataattgtggcatcggcaacttcattaagattgtgcggtggaatatccgttgccatacctacagcgattcctgttgtgccgttaagcagaatatgaggcaagcgtgcaggtaaatattgcggttcttctaaagtaccatcaaagttggcttgataatttaccgtgccttgtcctaactcggataataaaatttccgaaatttttgacaagcgagattcagtataacgcatggcggcaaaggatttaggatcatcaggtgccccccagttgccttgaccatcaacaagaggataacgataagagaaaggttgtgccatcagtaccattgctttataacaagcactatcgccatgcgggtgaaatttacccaacacatcaccaacagtacgtgcagattttttatattttgcactcgcattgagtcccaactcagacattgcataaataatacgacgctgcactggttttagtccgtccccaataaaaggcaaggctcgatccatgatgacgtacatggaataatttaaataggctttttccgtaaactggcggagtggcatttgttcaatgccttcgtagttgattgtgttcatatggttgtttttcgtttatttaatgaaaataaaaatgtatttaaactatgattttaaaatcatatcgtcaatattatcctgaaagacaaatttacgatgataatcaaggtatttttctcttccttcaggataaattcgcattttatttttcgcatttgggttgatatgcaatttctcccaagtataaatgcttagttgtgtaccgcagattagctcgccattatccgtaaatgtgatatatccctgatcaaataaccaatcgtatgtcggagtaagagataaaccattcaaatgatccaatgcctcattttcttttccttccgagatacaaacactgtaaggtttgatatggcttgcttttaataacacatcatctttaattaaagtaaatgggcattgtggcatataatctaacacttttctgcgatattctgactgcccttttcgccctgtccgtttaactgcacctttattttcatcaattaatttttctgtcatttgcgatgatgattcagtaagttttggatgaacaatggatctaaattgataatctaaaaatactctgaaataaaacaaaggtttttgctcttttccttgaattttctctggaagtagtttcaaaatagataaatagctaattttaggaagaattaatgctcgccatatattccaaatatcggcatctgaacgaatataacctctacgacgtgtaggattaccagtgactaaatcagacacatcataaattgaaaattcatttatctcattttttaaatcaataatagaatttaagtaatcattataatattcggaaatatctgtgtgataatgttgttcttgtttgtgaaattcaactctagcatcatagagatatttcaataggttgcttttactaaaaaaacaattttcttgaatagttggatattctgctctcttattgttaacttgtttagctgcccccctgttatgatactcaaaaaaatcacttaatctagaaccgctattgccaacataactaccgacatattttcgtgcttcaccattccctgtaaaaatggataatttgtttttacgatgaataaaactatcttccgcacgtaaattttgaatagcatcaataataatgtaattttcgccattaacatggattttttgaaatttttgcatattcctattctccgtattgtgtaatatccatttgttttagcaatgcgattaacacatcaacgacaatactatttcctgcttgtctgtatgtttgagtgtcgctgacgacaatttggaaatcatctctaaatcccattaaacgtaaacactctcttggcgtgagctttcttattcttccttgattatgagtaacataattatcgacgccggcacggtgcattttgtgcattgtttgtaataaaggacgagccactgataaatcagtttgtgtactcgttttgaaattctttgttccacctgctaaaacataatcacgaattttgctggataaataatatttttcttcgacatcattaatgttaaaaataaactcatcaaaactgcttttatttattttgggcacaaaaacaaaatcaccatgccaattaaattgttggttggctttttgacataacattatatcgccattaatttgcgtatagcgtttttgccgatttttagaactggttacaaatttaatgcctttttctttaagaaaatatttgctatcagtgtaatcctctagaaaatcttgcatcgtacgctctaaaggaatcttagttggaaattggaatccgccttttggcgaggttttaaatcctacaacaaaaatacgttcacgatgttgcggaataccataatttttgctgttcattacttgaaaatataaattgtagcctaagctatggaaaacatcttttactacttgccaagtatttccaccatcgtgatttaataacccttttacgttttcataaataaagacttttggttgagtctcatttaccactctcgcaaaatcataaaaaagcgtacctcgagtatcttccaatccgtgtcgttttcccaccatagagaaagcctgacaagggcttccacccactaaaatatctacttgatcacggtaaggtatcgcatcaaaagtggtaatatcagaatgccaatgttcttcagataaatcgtaattggctaaataactttttttaacgtggggatcaatatcgccagcaaaaacaatacagtgatttagttctaagcgtttgaaagcttgttctattgcaccaataccactaaacgtcgtggctaagcgtatttttgcattaggatttttaaatgttttaaaacgccaatcacactcatcaaataagggtaattcaaaatttaggtttgttttatccatgagatttgtcatataaatataaaataaattttctatttttagagagtactcaaccaaataattcacacagcaaaatctacttgatcaccgttattttgcaaccaaattttccgatcttcggaacgttttttagctaataacatatccatcaattctaacgtagatacatcttcttcgtggggttcgtaggttaattgcaccagacgacgagtgtttggatccattgtagtttcacgtagctgattaggattcatttcacctagccctttgaaacgctgaacattgagtttgcctctcttattttttaagcgtgccaaaatgctctctttttcgttttcatcaagagcataaaaaacttcattacctaaatctatacgataaagtggcggcattgcgacataaacatgaccattttgcactaattttggaaaatgacgtaaaaataaagcacaaagtaatgtagcgatatgtaatccgtcagagtcggcatcggctaatatacaaactttaccatagcgtaattgagataaatcttcgttgtcaggatcaattcctaatgcaatagcaatatcatgaacttcttgtgagcgtaacacttgatccggtgaaacttcccatgtgtttaaaatttttccccgtaatgggagaattgcttgatgttcacggttgcgagcttgtttggctgagccaccggcagaatctccttctactaaaaaaagctccgttttacttaaatcttgttcactacaatccgctaattttccaggtaaagcaggaccactgactaattttttacgcacaacttttttcgctgcacgtaaacgtctttccgctgaacttatcaccatttttgcaagttcttcggcatcttgaatattttgatttagccataaactgaaactatcttttacaacgccgccaacaaagaccgcactttgacgagaggaaagtcgttctttggtttgacctgcaaattgtgcatcgtgcatttttactgacaaaacataagcacagcgttcccaaatatcatcagcggttaatttaacatttttgggtaataggttacgaaactcacaaaattcacgcatagcatcaagcaaaccttgacgtaagccattgacatgagtacctccttgaatggttggaataaggttgacataactttcgttaagtaattcgcctccctcaggtaaccataataatgcccaacttgccgcttctttattcgtcgtaaaatcaccgacaaaaggggtttgtggcaagaggttataaccattaacattttccattaaataatcagataaaccgtcttggtataaccaagtatcctcagtgttattgattttatcgataaatttaatttctaatcctgaacataaaactgctttagcacgcaataaatgacgtaagcgactgactgaaaaattagcactatcaaaatatttcggattaggtttgaagtgaacggaggtaccggttgtacgctttccgcaagtgccgataatctctaattcttctaccttaacgccgttttcgaaggcaattttatagatttcaccgttacgttttacctgaatatctacacgctcagataaggcgtttactacagaaatacccacaccatgcaaaccacctgcaaattcatagtgcttattggaaaattttccgccagcgtgaagtttagttaaaataacttcaacaccggatactttttctgtcgggtgaatatcgacaggcattccacgcccattatcaatcacttctagagattggtctttatacaaaataacttcaattttggttgcgtgccctgcaagtgcttcatcaacactattatcaataacttcttgccctaaatgattagggcgagacgtatccgtgtacataccggggcgaagttgaacgggttcaagatcttttaaaacggttatttcttgtgctgaataatttgtcataatgccatgtgatcagtaaaaatttggagaattttaacaaaaaaagtgtcacctttcatcttgattgttgtgtatcttcttttgaattccaaggagcaacccagaataggcaaagcataccgggaatggctaaccagaaacaaaaccaaaaatagtcatagtatcccaagtagttgattaaaacgcctgcttgtgtattgaaggtaactcgaggtaaggcggcaaagctggtaaataaagccagttgagtggcggtataaagtggattggtttctcgtgccataaaggcgacaaaggcagacgtacctaagccaataccaatatattcagcggcaacgactaaactgagagaaatcagagcaaagttatctatttcttgaaatggacctaattttgccaaccatgcaaagcctaaaattgttacaatttgtacaacaccaaaaagccataatgcacgattaattccgattttcagcatgatgacaccacccacaatactggcgatgagcatcggccacaaggaagaatttttgaccactataccaatctgagtcatgttataacccatatcaaggtaaaacggggaaataagagcggttgccatactatcgccaattttatagagaaaaataaaagcgagaataccaagagcggaagacgtgcctttgcgtgtaaaaaattctttgaacggttcgatcacattttcttttaaagtgcggtcattttttagctgaatttgaggttctttacttaaaaataaggtcataaaaataccaggaagcatgaagagtgcggtaattaaaaagacagttttccaaggtaaatagtctgccaaaattaaagaaagtgagccgggaacaagccctgcaatacgataggcatttacatgaatagaattacccaagcccaattcacgatcagagagaatttctcggcgataagcatcaagtacaatatcctgacttgctgaaaagaaagacaccagcactgcaatacctgcaatcagttgtaaattaaaggaggagcttggttgtaaaaaaccgaataaagcgagtgaaatgagcagtaaaacttgcgaaatgagtaaccaacctcgacgccgtcctaaaaagggcggtataaatcggtcaagcaaaggagaccatagaaatttccaagtaaaaggaagcgttgtagctgtaaaataacctaaggtttccagatctacgtgttctttacgtagccaaagtggcaataaggaaatgataatataaaaaggtaatcctgagctaaagcctgtaaacacacaaataagcatattacgactaaagatttgttgcagaattgagtgagatttttccataatttttccgtatgtataaattttttcaacagtatagatgattttttcacgttcatgataggatttttttattcacataacaagtagataaaatcttttacgcaaacgtttactatttgaaagtttcaggtaaaatacgtgcactttttttattcattttaacttgcctataggggacgctatgtctttagaaaaaacttttgagttgacgaaacgtggttctaacgtacgtcaagaaattattgccggattaacaaccttcttggctatggtttattcagtaattgttgtaccgaatatgctgagtgcagcgggatttccggcagaaagtgtgtttatagcaacttgtttggtagcaggattaggttcaattttaattggcttatgggcaaatgcaccgatggcgattggttgtgctatttcattaaccgcctttactgcatttagcttagtgttgggacaaggtgtgagtattcctgtcgcattaggtgcggtatttcttatggggatagtctttactttaatttctgcaacaggtattcgctcttggattttacgtaatcttccgtcgagcattgcacatggtgcaggtattggtatcggtttatttttgctacttatcgctacaacgaatgtgggtattattgtagccaatcaaaatggcttattagttaagtttggtgattttacgtctttctctgtgctgatgtctttggttggacttgctgtaattattggcttggaaaaaatgcaagtcaaaggtgggatcttatgggttatgatcgcaattacgatcgcagggcttatttgggatcaaaatgtacagtttaaaggcgaaattttcagattaccgacttttggggaacaatccttgtttttggaattggatattatgggtgcattacaaccggcaattttacctgttgtttttgccttagtaatgaccgcagtatttgatgcaacagggacaattcgtgcagttgcaggtcaagcaaatttattagacaaagatggtcaaattatcaatggcggtaaagcattaacagcggattccgtaagtagcttattatctggggcacttggtaccgcacctgccgctgtatatattgaatctgccgccggaactgctgctgggggtaaaacaggtatgacagcgattgttgtcggtatactgtttttattaatgctatttttccagccattagcaagtttggtgccaaactatgcaactgcacctgcgttaatgtacgtaggattattaatgttaagcaatgtcagcaaacttgattttagcgattttgttggagcaatgagcggactggtttgtggcgtatttattgtactaactgccaatattgtaaccggaattatgctaggttttgcaactttagttatcggtcgtttagtttgtggtgattggaaaaaacttaatgtaggtacagtcatcattgccattgttttggttgctttttatattggcggttgggcaatttaattgtatataaaatgttaggtgggtaagcttagtcagctctcgaaagtatccacaaaaaaccagcgataacaacactgctatcgctggtttagttttatatgatgaattagttaaacacaccgctgacgccgacacggaaaccgaggcgaccacggctgtcggaggacataccgccggagacagcccatttaccatttttggaagttctgccgaggtttaaagagaccgcactttcgctgctataatgagcggcaccggcggcataagaccatttaccygggacgaaaggcacgtctttaaaagccatcgcrgcggcgataccggctttrgcgtctttgttgacttcttcaagacgttggttagttgcgtgtaattgrctgccgtttaccgcatcrgtkgattgatgagaaagcaaaccrgcggcaacattttgaatacggcgttcattgcctttgctgccyacggaaacgacgccttttgcmtcaacgccrgcrtarttgccgtyractttaccgataccgccsgtwgtwtcrcctttttctacatargcagaagaatcacckagraatacrgarttmtcrrcakyawywtkratattattwcckaygacaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctgcctcataacctacagcaacagcggactcgccgacttttgagccttttccaatagcaacggctttgnnnnnnnnnnnnnnnnnnnnnnnnnnnnnnnnnnnnnnnnnttcaccaatataaaccccactgttttcaatcttaatatgattattaccattacttgattgttgagcttgagccatagccgaatgagcagttaaaacaactaccgcagttaaagataaataaaaaattttcacttaaaagaaatccttaaaaaaagagttaacatagaaaaatcataaaaaarcaaccgcactaagaggcgataatttatgacamkamtaaaaaagaggtagggggatctaccaaagcgggcgagattttaagcggggggggggtactgtcaatatatttttttacaaaatgtttacttttttaacaaaattgaaacggaaaaacatttgtcgaacacgaaaaaatattcatttgtttttgtgttatggaatgcagtagaaagaagaaagaaaaaatgaaatgataattggcggaacggacgggactcgaacccgcgaccccctgcgtgacaggcaggtattctaaccagctgaactaccgctccgcaataaaagaaataataaggggaaatttggcggaatggacgggactcgaacccgcgaccccctgcgtgacaggcaggtattctaaccagctgaactaccactccgcaaaagtggagtgcataataatagtgaatagatttttcgtcaagttatttttatttattatgcacttatttttgctaagtgttgattaagcaaacattaatgcatcgtttcttttgtatttcgcttaaaccataagcaattttctttgcttttttggtttagcaattttagataatcttggtgagccagtttttcttcttctgtgggtaaaagtaatttgaaattatgagtattggtagtatgttgatgaatattttcttccatcgttataatcggcgtatgttcttcatcaccaaataaactggtttgcccccctgtcatggctaaataaacatcacctaaaatttcagcatcaagtaatgccccgtgcaatgttcgtttactgttatcaatatttaatctgtcacaaagtgcatctaaactattacgctttcctggatacatttgacgagccatttgtaatgtatctgtgattaagcaaatatccgctgtattgatattgaaattgtgttttttaaactcataatccataaaaccgatatcgaaaggtgcattgtgaataatgagttcagcccctttgataaaatcaataaattcctgtgcaatagctgaaaaatccggtttatctgccagcatttcatcagtaataccatgtactttaattgcttcaggatcaacgagacgatccggttttatgtaaagatggagttttcttcctgtgtagcgacgattgatcatttcaactgcaccgatttcaataatacaatgcccctcataatgtgcaccgaattcgttcattccggtcgtttccgtatctaggataatttggcgattttgtgtgatttctaatgtcatactattttgctgttgcttgaaatgaatttgcggtattatcgccccatttgagaaaaattagtagaaaattatgttaaaaaaaattgaaatttttaccgatggatcttgtttgggaaacccaggggccggtggaattgggattttgttgcgttataagcaacatgaaaaaaaactgtatcaaggcttttttcaaactacgaataatcgtatggagttaagagcggtgattgttgctctaaatagcctaaaagaaccctgttcagtgattttgtatagtgatagtcagtatatgaaaaatgggattacaaagtggattttcaattggaaaaaaaataattggaaaaccagttcaggtaatgcggtgaaaaatcaagatttgtggtgttcattggatcaagctattcaaaaacatcaaatagaatggcgttgggtcaaaggacataatggacatcgagaaaatgaaatttgtgatcagcttgctaaacaaggtgcggaaaacccaacgctggaagacgttgggtatcgagctgaatagaacaggctaaataaaactggcgagaaagcgtagtcgaaataaatgatttgactccaaaatattcgcctttatttttcaggtaatttcgcaatgactgcgtaaccttctttcaaaccttcaatttgataggtaacatcggcacaaataaatgcactctctccctgttttaattcaagtgcggtgtgatttgcggttatttttaatgcaccttgcatgacgagtaaaatctctgcgttacttgaggttagggtgtgtttttgttgcacgctataacgtacgtttgtcatggcaaaatctttagcgggcgtagtgtaagtaaagatgtcttgatcttgaggtgccttaggaataatttgaggcgtaatttcactgcaatcaactatttttaatagctcaccaatatccacatgttttggtgttaatccgccacgaataacattatcagatcctgccattaactcaatattttgacctcgtaaataggcatgcggaatgcctgcatcttgataaattccctcacctatattgagatgaacaatattaaataaatagaaacaaattaatccagcatccagtttatcagccggtatttccattgcttcaattgtatataaaacccaatagtcgggattatttaatttcagttttccctgtctataagcaacctgattttcagtaataataggggatagccacgcagaaagttgagtttgatcagcttgcataattgttgcataaaaactgtgtaagtcttgattttccagctgttgggcaagtgcggtcaaagatggacgggcttttaaggtttcaagaatgtttgttttttgtttgaaaccatgcaacagccaaaaatcagacaatgcaatcatcatttcgggtttatggtttcgatctttataagttcttttcggatcttttaaatctatggctgcaagattctcttgtgcaaaacctatttccgcttgtttttttgttgggtgaagttgaattgaaagcggctttgcaacatctaaaattttgagtaaataaggtaattcctgtccaaaatttgctaggcttgctttccctaaaacttgtgggttttgcaccaaaaaatctgttaatggcactgattttcccgaaatatttaatagagaaggggcggaagaatgtgctccaagccaccattctgcataatattggttgtgctgtttttctacgtttaacaactcgggaaggtaattttgtccgccccaaacatagtgttgtaaatgcccttgtagttgataaatggtattcattttgctgtccttttatttgataatgacttataaccgccaaaaaattgcactattttttctatatcttgcgtgttttccggtgaaatcataagacgttttttattttttaagtcaatcatcaggattttattttcaagcagattaatttgttgaattttagcataatcaatataaatattttcaaagaagaagccttgttctttcagtaataaaacaggaaagcgaataaaggcaatataaagactgagaagaatggtcattgctaataaatagagggttgttgtattaatttgtcctgaactttgatagagaatgatggcaacgagtacaataaaaatgagtgcatctatttttgctcgctttttcaaccgcactttcaatttcgttgttcctttaagatagtccatcataaattgatcgtaaaaggcataaagaaagaagcaacaaatacccacaataagaaaggcattaaccatatattacattcctaaaatgaaaaacttctcccgtgcagggagaagttttcggataaattaagctaagatacctgttgcggcacctaaaataccgataataaagataccggtaataatccataatgcgttaatacggttgcgtaataaccacatacaggcaaaagtgaacaataacggtaataatcccggcatcaaactatcaagaatattttgtacagttgttgtttcaattgtgccgtcttgtttttcaataacggatacgactaatggtacattaatactggtccatttctgcactaaagcccccataatgaacaaaccaagaatcgaggcaccttccgtaagtttttgcaacaatccgccactcatatcctgaacaacgtccaagccttttttatagccataagtaacaccatagtaacgtgttgctaaacgaactaaattgaatagcacgaagaataaaataggacctaaaatacttccattgatcgctaaacctgcacccaaagcagcaaatacaggtcttgcagtaccccaataaattggatcaccgacccctgccaaaggtcccattaagcctactttgataccgttgattgctgcatcatcaatttctttaccgttcgcacgttcttcttccatcgcaatagtaacgcccaataccggtgcagcaacgaaaggttgcgtattaaagaattctaaatgacgtttaatcgcatctttacgttcttgcgaatttggatccggatataaacgtttgatcacaggaaccatagaataggcaaagcctaatgactgcatacgttcgaagttccatgaaccttggaaaatgtttgaacgaagaacaacggcatttaaatcactttgggttacttttttcatttctgttgtcattttttggattcccattaatctaatctgttatctaaatcattattgttatttgctacaacttgtaccactttactttgattgtatttcgggtgaagctgaatataaagtgcggccatgattgcaccaagtacaccaagagcaacaaggttgaaatcggtaaatgctgcaataacaaaaccagcatagaagaatggcattaaatgacctgcacgcatcatattgatcaccatggcataaccgacaaccgcaataataccaccggcaatttttagaccgtttgttacgactgctggaatagcgtttaacatatcttgtacaacatcggttccagctgtcaacgcaacgacaagtgcagggattgcaatacgcattgcttgtaataatagtgcactacgatgaatccaatctaagcgggttaagttaccgtcttcaattgatttatcagcagcatgttggaagccgacagttaaagcacgaacaacataggttaatacttgacctgctgcggctaatggaattgcaattgcgataccggtgctaatatcttgtccaccgacaataactaagattgttgaaacaacggaggctaaagcggcatccggtgcaagagccgcaccgatattcatccaacctaacgccaagagttcaagtgaaccgcccacgataatccctgtttttatatcacctaagactaaaccgattaatgtacaagcgattagtggacgatgtgtttgaaattcatcaagaattgatcccataccggagatacaggcaacaataaagacaagtacgacttgtaaagttgaaatttccatttatgtcttccttaaattaaattattttttttgagtaaatccatcatatattgacgactgtcgttagatactttacgaacatccaattcaatgcccatcgcatcaatggctttgaatgcggcaatatctttatcatcaacagccaccgcactcgtaatcatttttttaccgtctttatatgccataccaccgacattaattgatttcatatcaacaccggcttctaacaatcttaaaacatcggtaggattagtgaataatagcatcatacgttcatttgcatattcaggattgttgtatacacggatcattttttctatattcacaacatgtgcggtaactcctggaggtgcaacgcttttcagcatggttgagcgaacttgatctttggcaacatcatcattgactacaacaatacgtgttactcgactttcttttgtccagcgagtggcgacttgtccatggattaaacggtcatcaatgcgagctaaacctacaatgagattgccttcttgttgtttgactgcgatttgaggttgttcagggacaggctgtgaaagtgcggtagtttcagccgatttttcttcatattttaaagcacgaacaccagcacggccggtttctaacgcaatgctcactaattcttgtaagctagggttatcgtcacgtgccataaaagtttccactaacataggcacatttacaccggttacaatatccatattagtgttatcaccaattacacgatttgccgcattaaacggactgccgccccaagtatccactaaaaacaggacttcatcgcaatgtgctaatgttgtacttaatttttcttgatacttcgtcataatcgtttcagcattttcgcctgaaacaaaatcaatagttgcaacattctcttgctcaccaatcaacatttctgttgttttaagcaattgttcagccgcaacaccatgcgttgctatgataatcgcaatggacattcggactccttcctaaaagtattaaattgatttaaagggcaggtattataaaggaagttttattttaataatgtgatacagatcacattttaagatgttttttgggtttaaagtgtgatgtaaatcacgctgattgcaaaaaaaagtcaaataaatgtgatttagttcactctttactcgacttattcaaaaatgcacaaacaatcaatttaacgtactttagcaagattgtttttttgagtttttaataattcagcatgtgctttcttttgctcttttattttattgttaatttctctacgctgtttagacagttccgcattacgaattgtataatcgtcaacccgagtttcgtaatcatcacgcatactttcaataatcgcacgcacatcagcaatactcatatcattacggatatattgattcaggttatccaatagcaacacacgcttttgattatcacgaattttacgattattgtcgtctatgtcgcgtaaaagtttgttttttaaccgatacatacgtacatactctaaaacttcttggaaagattgtttattgatattttccatttttttcttctcttttattaaatgaaacttcggctaatttaactttttttcccttattcgtcaaagtgttctctaggaattttcttgagctgtaaaaaattcagaaatttattaaaagttagttgattaagctgtgacgagatgatagaaattaaaaattctttttataaaaccaattaggataaaaatatgatgcaagtatttaattttagtgcaggacctgcaatgattccaaaagttgttttggaacaggcacaacaagaattgttgaattggctggatcagggtacttctgtgatggaagtcagccatcgtggtaaatattttatggaaatgattacacaagctgaaaaagattttcgtcaattgtataacattccggaaaattacaaagttttatttttacaaggtggggcaagagggcaatttgctgctattcctatgaatttagccaataaaaaaggcaaaacactttatcttactagcggacattggtcggcaactgcggctaaagaagctcgtttgtttacagaggttgatgaaattaatattttacttgatgggaaattagaagtaggggaacttgattttagccacattgcttcacaatatgattatgttcattattgtccgaatgaaaccattagtggcgttgagattgttgacgtaccaaatgtaggtgaggcggtattgattgctgatatgtcttctaatattctatcccgtgaaattgatatgagtaaattcggcgtcatttatgccggtgcacagaaaaatctcggtccggcaggtatcactattgtgattgtgcgtgaggacttaattggtcaggcaagaaaagaaacaccgtcaatttggaattatgaagtccaaagcaaaaatagttctatgattaatacgccgccgacttttgcttggtatctttgttctcttgtattcaagcatttgcttgcactgggtggtgtcaaagaaatggaaaaacgtaatcaggaaaaagcaaaattattatatgattttcttgatcagagtgatttttatcataatgttgttgcacctaaaaatcgctcattaatgaacgtaacatttaccacaaataatgatgaacttaatgcgaaatttgttgcagaagcgacagcttgtggattgcaagctttaaaaggtcataaggtattaggtggaatgcgagcttcaatttataacgcaatgccgattgaaggcattaaagcattaattgaatttatgcgtaaatttgaagcagaaaataactagaattttatagcaaaaacgaccgcactttaacggttattaatttcaaataaggatttttatgcaatacatcaacatcgccaacgaaggcgtaaaatccctgtctccttaccaggcgggaaaacctattgaagaattagaacgtgaattagggattagcaatattgttaagcttgcctcaaatgaaaatcctttcggttttcctgagagtgctaaacaagctatccaaaggcagttaaatgatctcacacgctatccggattccaatgggtttgaacttaagcaagtgatttcgaaaaagttcggtttgcaaccagaacaaattactttaggtaacggttcaaatgatttattggaattaattgcccatacttttgcttcggaaacagacgaaattatttattcgcaatatgcttttattgtctatcctttggtgacaaaagcgattaatgctgttgcacgagaaattccggcaaaaaattggggacatgatttagacgcttttttacaggcgattaatcataaaacaaagttaatttatatcgctaaccctaataatccgacaggcaattttttgactgaacatgaaatagatcatttccttgctcaagtacctgaaaaagtgcttgttgtgctggacgaagcctatacagaatttacagatgaaaaagagcggttaaattcttttaaacttttacaaaaatatccaaatttaattgtttctcgttcattatccaaggcgtatgggttagcaggcttgcgtatcggttatgcggtatcgaaccctgaaattgcggatttacttaatcgtgtacgtcagccttttaattgcaatgttcttgctttagtttcagcggtagccgtgatgcaagatgatgcttttgttgaaaaagtggctgaaaataatcgtattgaaatggttcgttacgaaaatttttgccgacaacaaaagttagattatattccatctaaaggtaactttattactattgattttaaacgtccggcaaatgaaatttatcaagcattgctacataaaggggttattgttcgccctattgccggttacggtatgccgaatcatcttcgcgtcagtatcgggttaccgaaagaaaacgataagttttttgatgcattagtaaaagtgttaggcgaggtctttgttgggtgaagaaaagtaatttatacttttgcaatatccctatttacaacttaagaaagcaacataattttatggaaaaattaacgttatctccaattagtcgcattgacggcgaaattaatttaccaggttcaaagagcttatctaatcgagctctgttattagccgcacttgcaaaaggaacgacacaggtaacaaatttattggatagcgatgatattcgatatatgttgaatgccctgaaagcattgggtgtgaattaccaattatctgatgataaaacggtttgtgttgttgaaggtattggcggtgcatttcaatggcaaaatggattatctttatttttaggaaatgcagggacggcaatgcgtcctttagcagcggcactttgtctaaaaggtgatacggagtctgaggttattttaaccggtgagcctcgaatgaaagagcgtccaattaaacatttagtcgatgcgttgcggcaaaccggagcaaatattcaatatttggaaaatgaaggttatccgcctcttgctattcgtaatcaaggtgttttcggcggtaaagtacagattgatggatctatttcttcgcaatttctgaccgcacttttgatggctgcccctctcggtgagggtgatatggaaattgaaattttgggggaattggtttcgaagccttatattgatattacgctggcaatgatgaaagatttcggaatcaatgttgagcattataattatcagcgttttttgattaaaggtaagcaatattatatttctccgcagacttatttggttgagggggatgcttcttccgcttcttattttttggcggcagcggcaattaaagggaaggttaaagtaacgggaattggcagaaattccattcaaggtgatcgtttatttgcagatgttttggctcaaatgggggcaaaagtaacttggggagaggattttattcaagttgaaaaatcagagctaaaagggattgatatggatatgaatcacattccggatgcggcgatgactattgcaatcaccgcactttttgctcaaggtgaaacggttattcgtaatatttacaattggcgtgtaaaagaaacagatcgactaacggcgattgcaactgaattgcgtaaagtcggtgctgaggttgaagagggggaagattttatccgtattcagcctcttgcattggataaatttaaacatgttgaaattgttacttataacgaccatcggattgcgatgtgtttttcgctcattgcattatcagatacatcggtaactattttagatcctgcatgtactgcaaagacttttcctacctatttttccgagtttgagaaaatcagcaaaaatcaatagattaatgggcaatttattgcccgtttttttataattaaattctatattcaatttgtgtaataagtaaaaagtcattaaaatgggcgagtgtttattcgattcttgtaatattttattcgattatcgaaaaaaatccgctttgtgtaattactacgccggaggctgtaattcagtatggtgatgaacattttttaatgttaaagattttatttttttccgttaggagttagtcctcatgagtattcaaactcacataaaagcaaaacgttctcatgtgtttttcttaaaactgtttttgggcatcattgtgcttttatttgccgttatgatcggtttaaaagttgcttcaaaaatgcttattggcaagatgatagccggtatgcccgaaaaaacgacaccggttacggcaattacagttgtaccaactacctggacacctgttatcgaaacaacaggcttggtgagacctaatcaaggtgcggttttgagtgcacaagcaccagggactgttgcaaatatatttatccaatcaggacaacctgttaaaaagggagatgtgttggttgagttggatatttctgttgaacaagctaatttacaggcatcagaagcaaaattaaccacagcaaaacaaatctataaacgctatctgaatttgtataaaacgaagagtgtttctcagcaagaattggataatgcaaaagccaattatgagtcgttggtagcaaatattaacgccttaaaagcagcaattgagcgtcgcaaaattgttgcaccttttgacggtattacaggtattgttaaagtgaatgttgggcaatatgttaatgtgggaacgcctattgtacgtgttgaagatacaagttccatgaaagttgatttttctattgcacaaaatgagttggaaaagttgtttattggacaaaaagtgacggcaacaagtgatgcacgtttaggtgaaacgtttggtgcaaaaattaccgcacttgaaccagcagtgaatgcagcaaccggtttaattgatgtgcaagcaactttcgaagatgaagacagtcgtaagttactatccggtatgtttatgagattgcgtgttgcattgacgaccgaaaaagatcaaattgttattccgcaagtaggtattagctacaatatgtatggtgaaagtgcttatgttttgaccgcactttctgaggaagacaagaaaacattacttgataacgaaaaatttgcttataaagacagtatagacagggtttatcgagtaaaacaaactactgtatttactaaagatcgtcagggtatttatgcacaattaaaagggcaagatattaagccgggtgaccaaattgtggttggcggtcagcaagctattaccaatggtagtttagtggtggttgttgataaagaaacaataggcacacaacaacctgccaagaaaactaatctttaattttaggtaggaatatatccaatgaaatttaccgatatatttattcgtcgtcccgtattagctgtgtcaatcagtttgcttatcattattttagggttgcaagcaatttcaaaattgagtgtacgtgaatatccgaaaatgacgacaacggtaattactgtagcaacggtatatccgggggcagatgctaatttgatgcaggcatttgtaacctctaccttagaagaggctattgcccaagcggataatattgactatatgtcatcaagcagtgcggctaattcttcgataattacagttaaaatgaaactgaatacagatcctaatggtgctttagctgatgtattggcaaaagtgaattctgtgcgttcaagattaccgcataatatagaagatcctgtgatttcatcttcaacaggtggtacaggaattatgtatatcagtttttattctgataaattggattccagtcaagtgacggattatatcgaaagggttgttaagcctcagttatttactattgaaggggtagcgaaagctcaaattttcggggcggctcaatacgcattgcgtatttggttggatcccgaaaaaatggcggcacaaaatctttccgcactggctgtaatgtcagctttatcggctaacaatgtgcaaacagcggctggaagtgcggatggttattataccgtttataaaaataaagtcgggacaaccactaattctgttaaggatttagaaaatttaattgtttattcaaaagacgataatcttgtacgtttgcgtgatattgctactgttgagctaaataaagaaagtgatagtacaagagcaacagcaaacggtgctgattctgtcgttttagctattgaaccgactgcaacagccaatccattaacggtagcggaaaatgttcgtccattgtatgcacaaattaaacagaatttaccaagcagtatgtattctgatttgctttatgatcgtactatcgctatcaatagttctattaatgaagtgatcaaaactattattgaagctactgttattgttttggttgtgatcttactatttattggttctttacgtgcaattttaattcctattattactattccaatttcattaattggcgtaatcatgattttgcaattatttgatttctccattaatttgatgacgctattggcaatgatcttagctattgggttagtggtagatgatgcgattgtggtattggaaaatgtggatcgtcatattaaagccggtgaaacaccgtttcgtgccgcaattattggtactcgtgaaattgcaatacctgttatctctatgacaattgcattgattgcagtgtattcacctatggcactaatgggcggaattacgggatctttatttaaagagtttgctttgacactggcaggtgcggtctttatttcaggcattgtagcattaactttatcgccaatgatgacaagtaagttactaaacaataatgcaaaacccaatcgtttggaacagcaaattgaaaaatcattaactcggttaaccaatgggtatgtttatgttttaaatttagttatggctaaccgtaagtgtatgcttgcttttgctgctattatttttgccatgttaccatttttgtttacttccctttccagtgaattgacaccagcagaagataaaagagcatttatcgctattggttccgcaccttctaatatgaatgtagattatgctcaggaggcaacgaaacagtatgttgatctgctgaacaaaacagaagaagtacaatttacaatgtctattgccggttttccaggctctagcggtacattaaatgttgtaaccttgaaagattatgaagaaggtggtcgtagtcagtcagagattatagaagagttgaatcgaaaggcaacgcaaattccggaagtgagtgtttctgcctttaattttcctgaaattgatacgggagaatccggagcaccgataggctttgttattagtacagcaaataactatcgtgatttagcaccggttgcagaagcatttttagcgaaaatgcgtgaatcaggcagatttgtttatacgaatctcgacttaaagtttgataccgctgaaatgcaaattagcatagataaagaaaaagccggaagttatggtgtttctatgcaacaaattagtagcactttagggagctatttatccgcagctacggtaagtcgtgttgatatagacgggcgagcctataaggttatagcacaagtcaaaagagcggatcgtttaacaccggaaagtttgaaaaatttctatgtatccgcaagtaacggaaaaagtattccgttgagtagtttaattagcatggaattggtaacacaaccgacatcattgtcaagatttagtcagttaaactcggcattaattcaagcagttccaatgccaggagtttcagtaggtgatgcggttcaatggctgaaagatgcagcgacggagttactgccaaaaggatataactatgattttcgtggcgaagcacgtcagcttgtacaagaagggaatgcgttagtaataactttcgtgttagctgttcttattattttcttagtattggcaattcagtttgaatctattcgggatccattggttattatggtttctgtgcctttggcggtaagtggagcgttactggtacttaacttcttgagcttattaactgatatgagaattttagggttatcaggagttaccctgaatatttactcacaagtaggattaattacactggttggattgattactaaacatggtattttaatgtgtgaagtagcaaaagaagaacaactttatttgggtaaatcacgaattgatgccatcactgaagcggcaagagtgcgtttacgccctattttaatgacaacagcggcaatggttgctggattaattccgctcttgttggcatcgggagccggtgcggcatctcgttttagtattgctatcgtattagttgcagggctttcaataggcactttatttacgttgtttgtattgcccgtaatttattcttatattgccagtgaacacaaacctttacctgagtttgatgaaagtataaaaccattggcgactgatcagcatcattaaattcaagcgataaataaccgcacttttaagtgcggtttattatttcaactattttatttgcaaacgcaattgggttttctaaatgagcattgtgtccggcacgttcaattaaaaataaatttaattgattttcttgtgccattttcttaaatttttcatccttttcaccacagaaataataaataggcagcgaaaaagaccgcactttttgatgaaaagatggttgtttggcaagtgacgttgcgattagcatttttgcaatattttggcctgattgatgtcttcgttgagaaattaattgttttcgctctcgtgcagataggtgagcaaaaacaggttgctgataccaatcatttaaaaccttggacatagtttcttggctaaaacgttttgcccaagccaaatcattctgccagcgttcaaggcgttgttgttcattttctaagcctaaatttgcaccttccaagataagtgcaacaagtttactttgtggatatttagattgcagtgcgtaatttaaggcaagacgtccccccaatgagtaaccaacgagaatataaggcttatcggcaatttttgcggtaatttgtcgggatagatattgtgcactttgttcaaaatcttctatgtgatagtttgtttgttcaccatgaaagggcagatctaaacacagataagattgtgaggaaaagtgcggtagattttttttaagttcttcgataatgtattgccaatcttgttttgttccaagtaatccatgtaaaaaaactaagatcggcatcatacgctatacctcttaaacaccgattaatgcatgaccaattttgtcaataagatctttatagatattactaccatcatttggattgactttaatttcgatgatggtcgtttctctgcgtgagtaggcttgtttaagtaccgtagccagatcagcccaagtataagggcgagcatatttgagatcgaacatagctgcaatatgtgaaaactcaagatagtgcgacatacggtaatatttttctttcactgcgatatcaacaggaagcatatcaaagattgctccaccattgttattaatgacaaagataattgccggttggtttagttgtttgaataatgcaaaagagtttaagtcgtatagcgtggaagtatcgccaatcattgctaccagtgtttgttcggaaccaacagcaattcctgccgcagtcgcaagcaaaccatcaattccacttgctccacgattagtgtaaattggataattagcggaaggttggcttagtgcatcggcaaggcgtacaaataaactgttccccaaaaagagaacgctattagattttggtagtaataattcaatattatgtgccaatgaggcttcatttaaatttgaacctacacgttgtttgataaagtccgcacagaatttagccaatgctaaaggctcaagtaaccaaggttttttccgcattggcggatgggctcgtaaccagtgatgcggtttagcattgaaacgtgtatgagcatgatgatagggatcaacagctttttgattattttcaataatccagtattcacctttaaattctgctaagaattgattaattcgctttccaataaatcctgagccaaattgaatgacgatttcagcttgtaacagtttttttctgacagtttggtttgccagccaaatatctgcataaggtagggttggtttaacatgggattgaatgtctgtaatcattatccaccccatattttctgcccattcagcaattcccattgcctgttcggaaggtaagcgtccaacaataattatgccttttttggttcgccattgatcccaatatttatgtgtaataacttccgtgtgttgttcttgatgttgaatccaatttttgttttgtgttagccaagattgaatattactgagccaaggatgaagatctatttcatcattattggcattatagagcggttcagcaaaagggacattgatatgaataacgcccccttgcttttgtcggaaacaagcctgatctaaaactgaaattagccattgagcagaatagttttgacttggacgaggcagatttatgctggcgatcgggtattgtgcaaacatattttgttgcaaaatagcttgattagcaccgcactcaagcaattcaggaggacgatctgcagttaagataattaatggcacatctgtttggcgtgcttcaataattgcagggtaaagattagctgttgctgtaccggatgtaacgattacagcaaccggttttttgctcgctttagcaattcccaatgcgaaaaatcctaagcctctttcatcgaaatgagtatgacaggtgccacgtccgttttcctgtaaacggatagcttctagtgtaagtggtgtggagcgtgaacccggtgcaatacaaaaatgagaaacaccttgacggctcaaggtttccaaaatcacttttgaccaacaacggttaaaaacgctggctgacatattttctactccgtttctttctgtaatagggatattagccctagtgctttacgttctatttcttgccattctaataaaggaatagaaccttcaacaataccggcaccggcaaatatacgaacataatcttgttcaataaatgagctacgaatagtcacacaaaactcagattctgttttagtcattattcccaatgcccctgcataccaagtgcggtcaaaagtttcggtattttgcaagaacacttttgcttctttttgtggtaaaccggcaatagctgcggttggatgtattgcatttaaacatactgcatcagtatttcctgctttaagtcgggcagaaatttctcgttttaaatgttgaacttggcgtagttgcttaatttccagttcactcaccgtaatttcctcaacatagggtataagatgttgacaaatgccctctacaaccaaactgttttcataaatatttttcggatcttgtaataaccactgagcttgttgctgattaatatgttcatcatttgttataaaagctgtccctgccaatgcttcagtgattaggcgattttctttacgaacatataatctctcaggcgtggagcctataaatgcttgtgtattattttgagcaaacaaaaaatgatagcaacctgtattgtacttctcactttcagctaaaaaatccttagcgtttaatgggctatcagttttaaagtcggtttcatttgccagcacaactttagtcagatttttttgcttaatttcatgcaatgctttttctacccaaagacaccattccgtttgatttgcttttgttgttatcaattgaattgattgatgaattgggtttaattgaacttgtttttccaaagaatgaataatattcaacagatcatatttttcttgttcccaaggttttttattatcaataatgagttgaataacaagtttttgttcttgtatgaatgataaacgtggcaaaataaatagaggttcaccattaaattgacagccgccgataagagataaattaaattgttgcacaaacgtttgtgctgatttaacttgcgtaaagcgacatacttctccaagccctaagatttttttattggtatcacgaaaattaagataaaattgcggataatgacattgagcttttaaccaaccgagtaaattcaattcttcatctaaatccaaacgaagaacggaaaagtcgtttttagggtcaaattggtattgattaattaagcgaataaactcagccttaatctcgtgcaaattatccattttgtatcgtattaagttaaacattcagttgaaaacagctcttaattctaccgcactttaaaaattttttttataaaatcttttcatctttttaaaataagcgtaaagtgtggctatattttgagtgacattattattaaaaggatagtctatgcgagttttccctaaatccgataagttagaacatgtatgctacgatattcgtggaccggtacatcaagaggcgttacgtttggaagaagaaggcaaaaagatcttaaaattaaatattggtaatccagcaccattcggttttgaagctcctgatgagattttggtagatattttgcgtaatttgcctgccgcacaaggatattgtgattcaaaaggtctatattctgcacgtaaagctattgttcaatattatcaatctaagaatattttaagtgcgaccgtaaatgatgtatacatcggtaatggtgtttctgaacttattactatgtcattacaagcattgttgaatgatggtgatgaggtgttaatcccaatgcctgattacccattatggacggcagctgcaacgttagccggcggaaaagcggttcattatttatgtgatgaacaagctgattggtttcctgatgtggcagatataaaaagtaaggttacttctcgcacaaaagccattgttattattaatcctaataatccaacgggagctgtttatagtaaagaattattattagatatagttgaagtagctcgccaaaatggattgatgatttttgccgatgaaatttacgataaaattttatatgacaacgctgttcatcatcatatcgccgcattagcaccggatttgttaacggttactttcaacggcttatcaaaatcttatcgtgtagcaggatttcgccaaggctggatgattttaaatggaccgaaacagcaagcgaaaggctatattgaaggtctggatatgttggcctcgatgcgtttatgtgccaatcatcctatgcaacatgctatacaaacagctttgggtgggtatcaaagtatcaatgaatttattttgccgggtgggcgtttattggaacagcggaacaaggcttatgagttgattaaccaaattccggggttaagttgtacaaagccaatgggagcactttatatgtttccgaaaattgatactaaaaaattcaatatctatgatgatgaaaaaatggtattggatttattgcgtcaagagaaagtgttattagttcatggacgtggttttaactggcaacaaccggatcattttagaattgtaaccttgccttatgtgaatcaaattgaagacgccttaggaagattagccaaatttttaacgcattatcgtcagtagttgtgaaacaagagagaacattttgctctctcttgttttgtcttttaaccttcttcacaaaaattttcaggtaaatttgtcagtattcctttccaaatagcactactacgttcacgattttccacaagataaacactggcttgttgataatctccatttcgacaacattctttcaattgttgatagaaagtgagttcaacttggcgtgattgcggattaataaaaaaaagtgcggcgacttgatgataaagtgttctaaaactgtttaaaatcaaagtatatacgggcttatccgatataaagctaaaacgatgatagaggttatagtcaaattccgcataactcttttcatcatcatctaattcatctaaagattggaaaaattcaaacgtttgttgaggattaatttttattgcttcaggaataaattgttcacccattcgagtacgtaaagataccacatttgcaatgacggtaggtttaagagtagacgataattgaatgagtgtttttaaaatattggggccagctgtttcccaaatattgtttactttggttggtttaccatgttgaatatttagccaaccatcacgattcaaacgctgtaatacttcacgtaatgttgttcttgttacaccgattttgtttgctagttcacgttctgcaggtaaatctgagccggcaggaaaatgattattccaaatgcttttgacaatatattcttcggctaacgcagccggactttgtgctttaagaatatccatacttctctttttgttaaacatactgtaataactaggtgggcattatccttgaaagcgatttatattacaatcatttaattatgttttttgctttcctttataagtgttttattctatattactcgtgcgtttgtatttttgtgttttgagtttttatgaaattaatttgatgacattaaggatcataggcatgctcatcttttttaaaaatttatcaatgaaacgtagtacttggatactgctgttcatttcagcattagtgttagaaagtaccgcactttattttcagcatggtatggggctgaatccttgtgtaatgtgtatttatgaacgtgtagctattttaggtatcctgttttcaggattgattggatttattgctcctagaggcttagttttacgcattttagctttacttattgggttaggtagtgcggtaaaaggattattattagcaatcaaacacttagattatcaacttaacgtatacccttggaatcaatgtgcaatggttcctgattttccccaaaccttaccattggataaatggtttcctaatatatttatgccttcaggttcttgcagtgatattacatggagttttttaggattttctatggtgcaatggattattgttatttttgcatgttatttcctatttttcattattctcagtataagccaatttaaaaaagtcagaaaaaacagaatgctgtttagatagctctgctcgttgaaatttttctcaaagtgcggtgttaaaatacattatttttgtaccgcacttatgttattaaaaaatcattccttaaagcttacttgttcctagcgtgaacgcatctcctttagggggattagacgtagggaaaatcaagatttaataaatcttatagattattttgtgtctaagatctttagcaaaacgctttaacttacgtataaacggtacgttttcaattttccattctttgggtggattttcaagttgctggaataaatgacaaaataaattcgcttttagcattgaacatttttcatgccatgatttttttggaccaacataatgaataatagcaagaggcatagtcgcttcttcatattgattccgttcttttttacttaccctttttagtctatttaacgcattggcagtaaaattatatcttaagtctaaatattttacattattcgcaaaaatagcatttaaaatatcctgatcttgatacaaaaattcaatattattacgtttacaatattcaatccattgtaatgatttttcaaaaacatgacatttttcccattcaactacattaattaataatacaccggcattaaaataaaaatgtgtattaggtagatgaagttttgttttataatctgactgactgactgactgactgactgactgactgactgactgactgactgactgactgactgactgactgactgctcattcttttgcttttttcttgggattcaataaaagcatcataacaagctccgattgccttgtttcctaaatcagtattccacaacggcaacagactatgattgaccaatatgtcaatatccaaataaataattttcgttaaattaaatttttttaaataacttgctagatttaacctggcgtaggttgataaagaaatatattctattgttctaggaaatttttcaaaatcacttatattaataggggtaatatccaaacgacagttgtttttattggctagttcaatgcaataatcctttgcaacagtagaaatacccatatccaacaaataaaaatgaatagtataacactcattgtttttatctctagcgtgaataatacttaacatagttactgctaaatattttgcataattgtcatcacatgaaaagagaatgttcatttgtttcttcttcttattaaggattttaatgttttactcagtatttttcttttttgtaataaatttaaatgtttatattttaaaatatataagagaaattcaatagagccacaattttgataaattaaatttagtatcatattgaaaagaacaacattaagcgatttaaaatcacttgctggtaaaatattttttttagatgaaataaattcggcaaaatcagataaatcattaaaacaatagttttcttggaaagagtagttaatgcctaatttttgtaagagaaagttggttgcttctattcttattcttctagctgatttttcttgtatatcactatattttgaagatatttgattatggtgtaccctatagtaagtaaatgattgagggatatttgccatttttcctcttttaagtatttctagccataatttataatcctctgcatgcggatatttttcatcataaaagagattatatttcttaaaaacatcgtttcggattaccatagtgggatgagtaaattgatttttaaatggaaattctcttaaaatttcttcatattctaaacagcctttccacacatctttatttttagtatattttcccacttttccaagtggaacatcattatcatgcaatatagtaataaatccgccaacagcaagcaaatccggttctctttccattttttctacaatcgtttcaatccaaaagggttcaacaatatcatcagcatcagttcttgcgacatattttccattacaatatgttaaacctttattaagagatttaataagtcctaaattagtttcattttgtaatactaataattcccccccctagcgtattcatgtgataatctatttaaaatttcctgagtattatcagtagatccatcatttactacaattacttcaatattattataagattgaagcataattgcacgaatacattcttctatatatttttctgcattatatgctgaaatgagtacagaaactaagttattcattatttttaacctctctataagaattttacaatacgccaaccattcaattttctttttaatcttcttctaaatcgccctatttccttcgaaatacttcgccataaattccttcttgcttttttattattttctctctctctctctctctctctctctctctctctctctctctctgcacgctctactgaaataacgctggttaacttgcagttgttttgatttaaaacattatcttgaataacaattgcaggagaaatttgataaacgggatattgttcttcttttaataatgattcaaataaaataacatcaattggctcaactgaaaaatcaggagatttaaataaatctaataatttttttgcggcaatttgtgaaataatatatcctgcagttccccattgttgagacattaattgaggaaaacaacgctgttgaaaaaatttaattttagttttgcgatatgctgaattcattaaataagtttctaaacgaagaataaaatactgattcacatcaaaccgctcttttaaccaatcatattgaccaagaaattgatgggcgactggactgagaataatgtcatcttcaaaaatagcgataaaaggtaaattttcatcaatacatttttgccataataacacatggctcataaaacagcctttttctcctattgtcagatcggttttatttaaggaagggacatattgttgaataatatgttcattttcttcattaggttgaaacgcattaaaaaaggaatatggaatattttgttcgccaaaatatttttcaatatgttgacgtctttcaactgaactttttaaactgataacatgattaaacattatatttcctaaaaataaaataacgtattctaacaatgatatgctatgtgcagagatattattataagaattttatacgacgataacctttcaatatccttcttctaaatcgccctatttccttcgatatacttcgccataaattcttttttgcttttttattatttttactctctctctctctctctctctctctctctctctctctctcgggtgcaagagaactggttaatgtgcagttatctttatttaaaatacaatcctgaataataatggcaggctcacattgataaaccggatattgttcatcttttaataattgcttaaaaataatttgatctatttcttcaatgaaaatatccgtatttttaaataacgctaataattttttagctgcaacttgagaaagaatatagcctcccattccaaaatgtccagacattagccgattaaatttacggttttggtagtcgggaatttttgtcttgcaatattctgatttcatataaattgtttctaagcggagaataaaatattgattaaaagcgaaccgctcttttaaccaatcatattcactcaaaaatttattggcgaccgaactgagaaaaatatcatcttcaaaaatggcaataaacggtagattttcatccacacatttttgccataataaaacatgactcataaaacagctctttagtttatttgcgagactgcttttacttaaagctgggacatagtgttgaaggatattttcattttcttcattaagttgaaaagcatcaaaaaaagtatagggaatatgttgttggctaaattctttttcgatatgttgacgtcggtcgaccgcactttttagactaataacataattaaacatagtttactcattttttatatataaaatgtagtggtttgctactcaattaaattgacagtataaaaaataatttctaaaatagccaatattttgttgaatttactgtgaattatgttagataatgccaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcaatcagcgatttttgtcataaatttagaaaaagcaactgaaagaaaacattttatttcccaccaatttaccgcacttcaagaacagcatcctgatatcgtaataaattatcagttttttacaggggtaaatggaaacacccaaccaaatcatcctttatttgctaaatacaatcaaaagaaacgctatcagcgaaaggggaatgaaataactttagggcaattaggttgctatgcaagtcattatttactatgggaaaaatgcgttcaattacaacaacctattatcgtattggaagatgatgctattttgcaacccaattttttagctgtttatcagttctgcttttctgcggaaaatcaatttgaatttttttggttaacgcactctaatagttcaaaaattagaacaaaattaattcacacgttacccgatagtacaaaattagaacaacattatttcggttatagtaacacgacaggttattatcttactcctcaagcagcacagaagtttttagagcattctcaagagtggatctacaatgtagatatttttatggatcgtttttatgaaaatcatgttgctttattgggcgtgaatccgccttgtgtcaaacccgatttttctaagcaaagccagattacgatgaataaaaacaaccgcactttttgggttaagttaagacgtgaatattttgcacttcttgagcgtatcaagcgttttgtttattggatgttttattgttgatgatagatatggataaagtgctaggtttacgagcagacaaaactggaaacaaaataggcagggaaattattagaatttccagttcaaattgatctgacagtcagctgttaaacagagactgtcagattagttgctttttattcttgtttgtttagtaaaaatacgccattttcagtgaaatgaacgtaggcctcgtgcgtttcttgtgaaaaattctctggattagcattgatcagtaaatctttaccgccccaattagctatgatttcccaataacttcccatatagaccgcactttttatgatgcaatgttgttgagcaagaccttctgattttagtttgactgcctcaggacgaatacccactaaacattctccatcgttcaaagcgaatttatccgcatcaggtaaaacaaattgatagtcgttaatggtaattttgccttgttctaaatagccattaaaaatactactttctcccataaaacttgctaggaatagagagttaggatatttgtaaagctcttttgccggtgctttttgcatgattttacctttattcatcacgatgacttcatcagataccgcaaaagcttctgtttgatcatgagttacatataaagaagtaatatttaaacgctgttgtaattcacgaattttttcacgcattgcacggcgtaaattcgcatctaaattacttagaggttcatcaaataataacactttcggctttaatactaatgctcttgccagtgctactcgttgttgttgtccacctgaaatttgatcgacatagcgatcttcaaatcctgccaagtcaactaattctagtgcctcttttactctttgtttgcgttcatcagaacccacaccttgcatttttaagccatagccaacgttatcgccgatggacatatgcggaaacagtgcataagactggaatacgatacaaatatcacgattttggatggaagattttgttacatcttcaccatcaataaaaatttctccctcggttggactttcaagtccggcgactaaacgcaataccgttgttttaccacaacctgacggtcctaataaagttaccattgaaccacgttttatgctcaagtttaaattatctattactacagatttaccaaacgatttggtgatatttttgagtactaaaaaatcattattcatatttatagcctttcgttaaaattttttatttttctaccgcacttcgctattcaagtgcggtaccgattaattcatttttttcgcttttgaacgggaaatgcgagtgtcaccaacgatccagtcgaagaataaaataattgccatcatcacaacaattaaaattgaaccataagcaatggctatgccatattcgccatcttcaactcgattcaaaatataggcagtagctactcgtgtatccgctgtaactaaaaaaacaatcgcactgacggttgtcattgctctaacaaagctggtaaccaatgcggaaagcaatgccggttttaataatggaaaaacaataaataaaatagtttttaatgaactgccttttaaagaaagtgaagcttcatctagagatttatctaattgcccaagtcctgcaactgccgctcgcataccaacgggcatgttacgcattaccattgaaagaataataattagccccgtacctgtaaggtaaatcggtgcatcattgaatgcaatgatataagaaacaccggcaacggtacctggtacagcaaagcaaagtaaggttaagaattctaaggtttttttgcctttaaaatctcgtcttactgtaatatatgcgatgagcaatccgaaaatagccgtaattggagccgcacttatcgcaaaaataaccgtttgaattaatgacggccaagcaccatcactgaaaccttgaccaaataacgttatgtaattttgtagagtgaaagtgtaatcaactccccagtttttagtaaagctgccgtagaaaatactgccatataagaccgcattaaagaggatccaaaaacctaacgtaaagacaacgatatattttaaggtcgttggtaattcttgtacgtctcctcgataggattttcccgatactgttacataagaacgattacctatccaccaatattgaataataaatattgcaagagaaaatatgagtaatatcgtacctaacgtgctggctgaagcataatccaattgagaacccgcaatgtaaaaataaatttgtgatgaaatcacatcaaagctaccgccaagtactaacggagtactaaaatccgctaatgattgaatcgctacaactaagaatgaatttgctaaagccggttttaataatggaaaaatgatgctaaaaaaagtttgatagcgatttgcccttaaagtataagaggcttcttcaattgaagggtgaattgattttaatgcaccttctaaaatcatgaatgacatgggagtaagtgctaaagtatgagcaattacaatacctgtaaaaccatatagccagttactgctaaacccaaaatactcaactaaaaatgaagttacataaccggaacgaccaagcattaatgttaccccaagaccgactacaaaaggtggggtaacaataggtaaaatagagaatattttgcctattaccgctgttcgcttagcaactctggtagtataaagtgcgaaaattaacccaaataatgtcgctagagttccaattgtaaatgcaaccgctaatgagtttccaatgatgcgtaaaacatagggtttactcacaatgtccaacacttggctaggtacaaatgtcgagccatcgtagaacatagaaaggaaaatggcgaaagttggataaacaataaagaaaaatataagtaaaatgatacttattagagaaaatataatgaacttatctccttgcataaatttcatttttgccaatgcgttggttgctaatgcaaccaacgtaataaccaagataaaaatggaatatccaagactgaacttttgcaaaatagcagacaaaaatacaaaaaagaagattcctacaacagcaaaaaattcaacttttccttgtttttgttccccgctatgttgaaataaatgagaaagtattggcacaatgagtaatgaaccaaaccaaagccaacttaaattaaacttagtccatcccattgcgtcataaatttcttcagatgtagaatctgttataccatagtgtaatgtcatagttggtaacacaaaaaatccaataaacgacaataaaatccatcctaggctacctttgaatattcgtgtctgttcactcataaaacctccgtgaaacaaaaattactttgctaatttaacttctgtaacccatttatcaataatcttgctgcgaacttcatttgatccaaatcgatcaaaatcataatcgattaagtttaattccgttggcttaagtgaataaggcgatggttcagcattagcattagttggaatatgatgagattgtgccttttgccaagaaagttcttgagcttcttttgacattacccagtcagcaaataattttgcatttttcaaattacgtgcatttttaatgatactgattccgcccagttcatagcccgttccttcacaaggaacaacaagctcaataggtgctccatttgctttttcaaaagagtaattttgtaaaaagcctacacctattgctgtttctcctcttgctgtatttcttgacggagctgtacctgctttaggatattgggatacatttcgatgaagttttttcaagtaattaaacgctgcatcttctccccataattggataaatgttgcaattgccgtgtaagcagtacctgagctttgaggatcagctaattgaatttcgttttttagccgtggatctaagagatctttccaacattttggaatttcagtaatacctaatttttttaacctttcggtatttacaccaaagcctaatactcccatgtatacaacagaactctttccatttcctaatttttgaaattgaggaagcacttctgccaatttcggtgatgtgtaaggttcaatcagacctagttccaccgcttgtaagtgcgtgtcgaatggaccgccaaaccacacatcggcttgaggattatttttctctgctaacatttttgctaaagtgctacctgaactattgcgaataaatgatgcagtaacattgtatttttcagaaaaaccttgaacagctttttcgcagactatattttgagcactacaataaaccactactctccctgccgattttgccaaggtttgagcgtgaaataaacttgcaaaaaataaagcggaaagagataaagcaaattttgataacttcatacttattctcctaagtaaaaaatatttttatttagccaatttaacttcattaatccattttgtaattaaacgtttacgttctacaacgtcaccatatttttcaaaatcataattaataagttgtaatttcttaggatcaaaagctaccggtgattgttctgctgtcgtgttagttaatgtttggaatgattttccttttttccaagctaattcttgcccttcttttgataacgcccaatctacaaacaatttagcattttctaagtttcttgcacctttaataatactgacacctcctaattcataccctgttccttcacaaggtacaatcatttctattggtgcaccttgttgtttttgcaatgcataatcatgtaagaaacctattcccacagctgtttcaccacgagcggtattattagagggggtaattcccgattttgtgtactgtgaaatatttgggtgtagctgtttaaaataatcaaaagctttatcttctccccaaatttgaataaaagttgcaatcgctgtataagcagtccctgaactttgtgggtcagcaatttgaatttctcctttcagacgaggatctgttaagtctttccagcattttggaatttcagtaatacctaactttttcaatcgttccgtgttcacaccaaaacctaaaattcccatatagatagcagaggtataattacctttcactttagccggatcttggaaacgttctacaatatgattaatatgcactgaacgatatggcgttaataatcccatttcagctgcttgtgcttgaggatcaaacgtacctccataccatacatcggcttgaggattatttttttcagcttcaatttttgctaaagtactgcccgaaccattgcgaatgaaagaggtttttacattatatttctcgccaaaagctttggtttcagcttcacacatctcattggtggcactgcagtagacaactaaacgcccctttgcattaacttgagtcgttaccattaatcctgttgcaaaaagtgcggttgatattgcccaagatatttttttcattttcatatggttctccttgtttgaaaaatacctgttgtaagacagtgtaggaatgataacacaagaaaaaataggatcatgtgaggaaagtcacacaatacaaaataaaagggagtgatacataaatcttctgagaatgactgtcaatacaggtaaattttctttataatcggcataaattttcatttaaagtaggtggaatattatccatgtcagatcagtcttgtattattattgccattgctggtgcgtcagcatcggggaaaagtttaattgcatcgactattcatgaggaactgtgtaatgaattaggctgtgaggaaattgggattgtgacggaagacagttattacaaagaccaaacgcatctttcttttgaggaacgtattaaaacaaattatgatcatccaaattcaatggatcgtgatttactaattcaacatttatgcgatctaaaaaagggtaaagtcgttgatattccagtttatagctatgttgaacatacaagaacccaagaagtaactcggtttgagcctaaaaaagtaattattttggaggggatcttgttattaacagatgagcgtattcgtcaggaagtaaatatgtcggtttttgttgatacacctttggatatttgctttattcgccgtttacaacgtgatatggaagaacgtggtcgctcattacagtctgtcattgatcaatataaatccacggttcgtccaatgttcttacaatttattgagccatcaaaacaatatgctgatatagttgttcctcgtggtggcaagaatcgagttgcaattaatatgttaaaagtgcaaattcaacatttgttaaataacaaataaggaacaaatatgagattatgtgatacagatattgagcgatatttggatcaaggtattatttctttaacacctagaccgagcaacgaaaagattaatggtgcaactattgatgttcgtttgggaaattcttttcgtgtttttcgtgaacatactgcacctttcattgatttaagcggtcctaaagaagaggtgaccgctcaacttgatgcggtaatgagtgatgaaattattattggagagcatgaagctttctttttacatccgggtgaattagccttagccacaacattagaagcagtcaaattacctgccaatattattggttggttagatgggcgatcttcgttggctcgtttagggttaatggttcatgttaccgcacatcgtatcgatccgggttgggagggaaaaattgtcttagagttttttaattctggaaaattgcctctagcgttacgtcccaacatggtgattggtgcattaagttttgaagtattaagtggtactgctgcgagaccttacacaagtcgcaaagacgcaaaatataaacatcagcaaagtgcggttgccagtcgtattagtgaggacaagtaagggtatatctgattatgtggaaaaaaatcttcttttttattaccgctctttttgtcggcatagcaattttcacgtatgtgcagattgaaaaaattcaatcaacgttagtcgcaagattaaatgctaaccaaatagcggttgacaacattactattgattttttccctacaaagataacgcttactaatatccaatattctaaacatccttctcacattaatattgacacggcaaatattgaaataagcgtattgaatttattagcgggtaatcttgctgtaaataatattgttctaaacaaaatttcccactcatatccatctttcccagctgttcagcacttaacaatgatagggaaaattacacaacaaaatagcaacattttctttgataatgtgcagctggaactgcaatttactcaacctgtttatttggataaaagaacatttaattttcatattattgaaggattttttaatcaaaatgagatggagactcctaaatttgaaggaaatatcgtcataaatcagcagcctgtgctcattaaagcggagatctatcaatcaaaaaacgaggaaaagggactaaagattttgtttaaagctagggattgtgagcaatgtgcggcagagtttgaatataattcaactcgtgatctttcatcggtgtttacagaaggaactttgcagtttagcagtcataattttcccattgaatattggcttaaaatggcagatttagagccagttataacaggaaaagctgatattgttgcgagtggtgtagtaaaaaataatcggttacaaaaactggacatgccaattacggttaaacaaggatctctatccggcgttaatttgttggagttggcgagcgggattttacctatcaattacgatagagaaaatgcaccgagggatatggcttttgaacatcttcaactcaacgcaaattgggagaataacttattgtatttagaagatatatttattttgactgagaatattattattgaaggcaagggaatttccgctcttgatcagatgcaatgtgatattaatttagttatgcgaccgaccaataaaaaatatcaaaatgtcagtttaactgtacatttctttgatcagtgcaatcgccctcagtatcaattgaaaatccgagcaaaagattatttaaagcaattactaaaaagaaaattttcccattaagtctcatgttaatcatgcagtcttgtactgtgctgaaaaaataaattcaattttaaaataaagtgatatttactatacactttctttcttacctttataaaattattgccaataaacatcattgcaagataaaaatctaaaaataattaaaaattggaattaaataaatatttaattatatttaaaagcaaaaattcaaattaaaatgctaaaaatgacattgacttaaccataaaatttcctcattattgggtaagtaatttacgaggaaaaaattatgtttttattaaaaaagttcagtcatcttttagcaaaatacaccgcacttgttatcattacattagcttgtgttactttttattccccaaatctttttacttgggtaaaaggtgatgcacaaattattgtacttggtctaataatgctatcaatgggcatgaccttaggtaaagaagactaccgtattcttgcaaaacgtccttttgatattttagtaggaactatcgcccagtatagtattatgccttttgttgcaatttctattgcacaactctttaatttgtctctagggttaactttgggtttagtgttggttggttgttgtcccggtggtgttgcttcaaatatcatgagctttctttgtaaaggcgatgtggcttactctgtgggtatgactactgtttctactattttagctccaataatgaccccacttttattgaattatttagtaggtgaaacggttgcaatggacggttgggcaatgtttaagtttatgttgttagtaacattggttcctgttggtattggctcaattatgaacataacgtttgaaaataaaaaatggtttcaagagttgcgtgaattaatgccgggtgttgcggttattaactttgcttttattgttggtggcgttgttgcggtacatggaaataaatttttagaatccggttttataatttttgtatgtattgttttccataatgttattggatacatcttaggtttctttacagggcgtttatttggaatgagtacagctaaaaaacgcactttatctattgaagtaggagtacaaaatgctggtttggcaacaggattaagttcaaaatttttcccaactaatgcggagtctgctattgcttgtgcagtatcttgcgtatggcattctatttcaggcacaattttagcaaatttatttttatggtgggataaacgcaaaaatacatcaactcaaaagaacaatcctgctaaaaatttaatgaatagcacgaaataaaataataaaaatttataccgcacttgagtttgtaagctaatcaaggtaatgtatgcgagtttattttattattgttttatgaggttaatatgaaaatcattcttttgggggcacctggtgcaggcaaaggtactcaagcacaatttattacaaataagtttggcattcctcaaatttctaccggtgatatgctacgtgctgcaattaaagctggaagtgaattgggacaaaaggctaaaatcttaatggatatgggacaattggtacctgatgatttgattatttctttggtgaaagaacgtgtagcacaagaagattgcgagaaaggttttttacttgacggtttcccacgtacaattccacaagcagacgctttaaaatccgttggtatcagtattgattatgtattggaatttgatgtgccggatgaagttattgttgagcgtatgagtggtcgtcgtgttcaccctgcttctggacggacttatcacattgtttacaacccgccaaaagtggaagataaagatgatataaccggtgaagatttaattcttcgtgcagatgataaacctgaaactgttctagatcgtttaaaaatttatcataatactaccaaacttttggttgattattatcaagctgaagctgcacaaggtaacacgaaatactttcgattagatggtacacaaaaagttgaagaagtaagtcaagaattggacaagatcttgagctaagtgcttaaacagttcagacctctatgactacttaatactgagaacatagaggtctgcttttattcattgaatataaatatgctaattattgtgcaactattaccatggcaggtctgataactcgcccatttaatagatagcctttttgtaaaactactgtaatttgattactttcaaacccttctgttggttgcatggaaatagcttggtgtaattcagggttaaaagtttcgccaattacaccgacaggttcaacaccgaagcgtgcaacagttgataaaagtccttttaaagttaactcaacaccatcgactaaacttttgatggtttcattttctacattagcaggagtagacagtgcacgttctagattgtctatcgtttccagcaaatctttagcaaatttctctaaagcaaatttatgtgctttttcaacatcttgttcagcacgacggcgtatattatcaatttcagcacgtgtgcgtaacaaaatatcttgttctttttttacagcttgaataagctgttcctccagttcttgcacacgagcaatagcattttccaacgcatctccatcctgtatttcggtttcttccattggtttttcttgctcattttgagtttcaagttcagctgaaatttcctcttgttcgactttttcttgttctgacattatttttttactccattgttagatttgtatcattgtatcaaaaaacatagaaattaacacccgcacttattggcaagtagagtagaatgtgtgtaatatagtactccttttatttaattcaagtgttctttgtagaaagaccatgacaccagcaaattttattgatagtaaaaaattaattatttcgtttaagacgattgccttagtaggacgccctcgtcatgatgtgaatttacaaatgcacaaaaatttatttcattggctttctgaacgtggttatcaagttttagttgaacgagaaattggtgaacgtttaggattgtcggtaaatcatttagcggatttagatgaaataggctgtttagcccatcttgccattgttattggtggtgatggtaacatgttaggacgggcgagagtcctagctaagtataatattccattaataggtattaatcgtggtaacttagggttcttaactgatattgatccgaaaaatgcttatgctcagttagaggcttgtttggaaagaggcgagttttttgttgaggagcgttttttacttgaagcaagtattgagcggaatggagaagttgttgcacaaagcaatgcaataaatgagacagttatttatccggctaaaattgctcatatgatagattttcatgtatatattaatgataaattcgcattttcgcagcgttcagatgggctgattatttccacaccaacaggttcaactgcgtattctttgtcagcaggaggtccaattttaactccgcagcttaatgctattgccttggtgtcaatgtttccacatacgttatcttctagacctttggttattgatgctgacagtaagatttcggtgcgttttgctgaatataatacatctcaattggaagttggatgtgatagtcaagtagcgctttcttttacccctgatgacattgtacatatcacaaaaagccaagataaattacgcttgttacatctaaaaaattacaattattacaatgtattaagtacaaaattaggttggcttaaaaatttagcttaaaaaatttttataagtctatttactgtatataaaaacatatatataattgtatttatatacagtaaaggattcatgctatgttagttcaacttaccattaataactttgcgattgttcatcatcttgatattgaatttgcgaaaggtatgtcagttattaccggcgaaactggagccggaaaatctattgctattgatgcactcggactttgtttagggcaaagaacagagttatctatgttacgtgacggacaagagagagtggatgtttgtgccacatttcatattgagagcattaatcctgcttatcaatggctacaagagcaggagttacaagattctgacaaccctgaatattgcattttacgtcgaattattaattctgatggacggtcgaaggcttttattaatggcgttgcagtatcagcctcacaactcaaaactattggacaatatttgattcagattaatggtcaacatgcttctcaacaattgctaaaaagtgactaccagattcatattattgatcaattttgtggacatgaggacttattgaaaaatatgcaagaaagttaccgcacttggcgagagttacaggaaaaagtaacgacatttcatcagaaatgtgctgaaaatgaagcaaaaaaacagctattagaatatcaagtagaagagttagatcagtttaatttgaaagaaaatgagtatttggagttggaagaagagcatactcgcttatcaaatagtgaagaattgatgtctttatctcagtcaacattacagttattaagtgaaaatgagagtgtgagtattgatagcctgctttataaagcaacacaatatattgatgagctttgtcaattggattctaattattctgatgtgcaaacaatgttgcaagaggcacttattcaaattcaggaagccacgtctgaaatacaacatttatcctcaaatattgatcaggatccaaaactgttacaggctgttgaacagcgtatgggacaagtgttacaactcgctcgtaagcataatgtgaaaccacaggatttagttgaattacataaacaactgaaaaatgaacttgagcaactcgttcatttttctgaaagtgaatcgcaattgatacaacaagaagaacagatgcgacaacatgtgcaagaaattgcaacgaaacttagcttaagtcgtcagcaaggggcaataaaattatcaacacaagtgacacaatctattaaattacttgctatggaaaatgcggagttctcaattacttttgatgaggataaaaaactcacaagtaaaggttatgatcaactttgctttaatttgagagcaaatctaggtcaatcagtacaacctttaaataaggttgcttccggaggggagctttcacgtattgcattggctatacaggttttaacctctgataaagcagctgttcctactttaatttttgacgaaattgatgtgggaattagtggtgctacagccagtgttgtgggtaaattattgcgacaattgggcgaaaaatgccaagtcatttgtgtaacgcatttacctcaagtagcttgctgtggacataatcattttgctatagaaaaacaggttatagaaaataaaacaataactaaaatgaccgcacttacatcagaacagagagttattgcattagcaaaacttttgggggggcaaggcattggtgaaatggcattagctaatgcacaagaaatgttggatttagtcaatataaattaaatttcatttcgtatatttcaccaaaacggattatattgtatccgattttagatctgatctattaataacagactctagcctcagtacataaaaatgcttatgaagtaaatagctgatactgtttcacttatattaattctattgtctgaggtagagaaaaccatacagcacggacttcacatcgatgtttttaagtctgattttttaaccctatataacctcgtttttgcaaagttgcttctttggattttctgatcattgtttctattgtcgtgccttgaattaaaattgaaaagagaacaacgctgtaagtaataataataaataaatctcgcacattcataccgatattttctaaaaatgcacttgttgcaggaatagaaagtgccatggcaagagagagaccgcctcgtaagcctccccaagttaaaattcgtaaagtataaggattgtacacagttttcatacttaagaatttgaatgggatccatacgcttgcataacgacaaaataaacataccggaatagcgactagacttaagatgatcgcttgtgaagtaaagttcaccaataacatcgcagagccaattaataagaataaaagtgaatttaagaaatgatcaatcatttcccaaaagtgatcaagatagtgttgactttgttctgaaaaaccggagtgtcttgtccagttggaaatcataattccggctacaaccattgccaaggcaccagaaacatgaagcaaatttgctaacataaagccagcagtaggaatggttaaagtgagtaagatttctaaacttccgtcatcggtagctgaaatcagaaaatgagcaataacacctaagattaagccaaagaaaattccaccaacggcttcagctaagaagagttttgtaatctccattgcagttggctcatgtccaccaaatgcaacggtaaaaatagtcgtaaaaataactaatcctaccccatcattaaataaagattcaccctctactttcatggataatttttttggtgcttttaagtttttaatgatggccaatacagcgatagggtctgtcggcgaaatgagagcgccaaataaaatacaataaataaaatctatatgcagttttaataaggcagatattccgtaaaataaaactccaataaagagagttgatgctatcgttgaaaacaaagctaatattgtgatctccaatttttggctttttaatacaggtaatttaattcccaatgcaccagcaaaaagtagaaatcccaagatgccatttaataggaaatctttaaaatcaatgcgttgcataacgttttgagcaatgtcgtctaaatggaataaattagtagatcctgcgattagtaatatcagtgaacctacagttgctgttgcggtgattgcaattgtgtattgaatacggtcactgattttttgagtgacaaaaccgattaaaatcgatatggtagagagaaaacaaatgtaagtataaatactcataagaagtaccttctaaaatttaaaaatctgtttatattttattaattaatcaaattagtaaaatataaacagacttgacttgttctaattgagatagtcaagtagcgattgggcattagaaagttaataaaatgtaacaagaaaaatttttgcctagtataagtaaagtcctactttttataaagttcatttttataaaataattagaaatagttaatttatagcgttattttcgaccgcacttttgatatgaaaatgcttgtttaaggatagtaatggcagaataaattttgtttgttctgccattatatgttgaagaataaaaaattaacattttgcaacaataacaatttccactttccatttcgggtcagccaattgactttgcactgtggctctggtaggtgcattatgagaatcaacccattcatcccatgccttattcatttcttgatagtcttgcatatcagctaaaaaaatttgtgcattgagtatgttgcttttatcggaaccgatttctagtaataatttatcaattagacctaatacttcttttgtttgtaaataggcatctacatcagtattttccggtacttgtccagcaaaataagcagtattattgtgaatcgttatttcagatagccgtccgttagaatgaaagcgttgtattttttccataatgtctccttagtgaataatgaaattatgtataaagattatagcgatttttgtaaaaatggactaggatctgcaagtttttcttgaattattgtagtggaaaattttgtgtgaaaatgctgatttctaaccaacatggtgcaactttaatggcattaatgccatttttatatggtatgcttttggctaaaccgacttggcagcattcctttttatttttggcttggtttagtctatatttaatgagctatcctttttttcatttgttcaaaggtaaaaaatcgaattttataaaatatcaaaaatacacattgatttatggcacgacaagtttgatatttgcactacctgttttttactacaattggcacattttatattttcttatcgcaatgttaccttttggcttcatcaatatttattttgtaaaacaaaaaaatgagcgagcattaattaatgatttggcggggataattatctttgctattgccggtatggcaagctattatttttctacttttacctttacccaacaaatttggttagttgctttattgccaagtttgtatttcatcggcactactttgtatgtcaaatcttgtttgcgtgaacgaaaaaatcctaagtatttattggcttcttacttgtggcatgttgcttgtgttgttctttttgttgcaatacaacagttttatcttgcatttgcttttgttataccggcaatacgtgcctattttttaccgaagatgaagatctcagctaaacaactcggtttaattgagattgcggtagcccttgtattttttattcaacttctttttgccactttatagagaagaggactactatgaaattactaatgttatgtcgagaacctcgcctttacagttgtcagcgtttaaaagaaagtgcggaagataatgggcatcagatagatattctagatcctaatcgttgcttattaaaactctcgaaaaatgcaccgcactttgagttgtattatcaagtgaatagtaaaagcgagccgtatttattaccggattatgatgcgattattcctcgttttggttctacaagcacaagaatggggtgtgccgtgttacgacattttcgtacaaaaaatgtattttgtttaaatgatgatgttgcgtttttaaaagccagagataaatggcttagtttacagttattgactgaacaaggtattgctgtccctaattcagcattgtcaggtgcagaattttctgccactcaagccattttgcaaattcaatcgccgacgattttgaaaacgttacacggttcacaaggaataggcgttattttggcagaaaatcgtaaaagtgcggtgagtattatggaaactttaactcaagcagacgtaccgttattaatgcaggattttattcaggaagcacaaggaacggatattcgttgttttgttattggtgataaagttgttgctacaatgcaacgtattggacaagaagatgaatttcgtgccaattttcatcgagggggaagtgcagagaaaattcagttaaccgaacaagaaaaagtactagctttaaaagcaacgaaatgtttagggctagatgttgcaggtgtcgatttgatccgttctaaacaagggttgttagtgctagaagtcaatgccagtcccggattggaaatgatcgaaaaaaccagtggaattgatattgccttgcaaatgatagttcacattgaaaagcagtttaagagataatgttttgctcgtagtgcggtagaaaaataccttgttttttgttttaataatgaaatttaaaaaatcccgatatttacaaaggattcacaccttaacatactgaataaataggttaattatgttcttttggtatcaaaatcacgttatagctaagttacttgtttggctgttattcccattttctttggtcttttggtttatttctgttattcgtcggagattatttcgattaaactggctgaaatcctaccgctctcctgttcctgttttgattgtgggtaacttatctgtggggggaaatggaaaaacacctgtaacgatttggttggtaaaacaatttcagtcgagaggtattaaagttggcgttatttcacgtggatacggtagccgagcagagtattatccatatttagttaaaattgatgataatccaactatttccggtgatgaacctttgttaatcgcacaacgtacaggcgtacctgtttgtatttccccgaatagacaacaagcaattgagcttttactggcacagtttaattgtgatttaatcattagtgatgatgggttacaacattataaattacaacgtgattttgaaattgtagtgattgatggcgaaagggtatttggcaatggttttgttatgccggcaggacctttaagagaattaccaaatcgtttagcggaagtggatttaattattaataatggaaagctaacaggttatagtaatacgttcatgctcttattacctaaattcgccgttaatttagtcagtggtgagaaaaaactattacgtgattttcaacgtattcctctcaatgcaatagcaggtattggttatccgcaacgtttttttaatatgttacgagattttgcgttaactcttgaaaaaacgcaaagttttcaagaccatcaggattttgatgcagtacatttctcatatttctcttcaaatcaaccgctctttatgacggaaaaagatgcggttaaatgtcgtccttttgcacaggcgaattggtggtatgtgccggttgaggctgatattcagggagaagaggtagaacgatttatgcaagttgtttcacaacaaataaaggagaaaaaatgaacggaagattattagaaattgtcgcatgtccaatttgccaagggcgattgaaatacgacagtgaaaatgagcaacttatttgtcactttgatcatattgcttaccctattaaacaaggtattccaattttactttccgatcaggccataagtttgtctacatctttaaccaatcctgagcaacaaaatcagtaataaggagaatattcatgaatttcacggttattattcccgcacgttatgcgtccagtcgcttaccgggtaaacctttggctgacattgctggaaaaccaatgatccaacacgtttgggaaaaagcacaacaatccggtgcaacaagagtggtcgttgcaacagattatgaggaagttgcacgagcagttcgtggttttgatggagaagtttgtatgacttcctctcagcataattcaggtacagaacgtttggctgaagtgatagaaaaattagctatacctgatgatgaaattattgtgaatattcaaggtgatgagcctcttattccccctgttattgtgagtcaagttgcacaaaatctacaaaaatatcaagtgaatatggcaactcttgcagtaaaaattgaagatgtggaagagttatttaatccaaatgtagtgaaagttttaacagataaagatggttatgttttatatttttctcgtgcagttattccatgggatcgagatcagtttgttcaactgggtaaagcagatttatctcaattgcaattgcaccaacattatttccgtcatattggtatttatgcttatcgtgccggctttattaaacaatatgtacaatggcaacccacaacattggaacaaattgaaagacttgaacaattgcgtgtcctttggaacggtgaaagaattcatgtagaattagcaaaacaagcacctgccgttggggtagatacggtagaagatttagaaaaagtgcggtctattttatctcatgtttgatgccaaaaactttcttgccaatgtaacgcaccagcccggtgtataccgaatgtttgatgaaaaagggcaggtgatttatgttggtaaggcaaaagatttgaaaaagcgtttatccagctattttcgcactaatttgaatagtaaaaaaacttccgcactggtttcgcatattcattcaatagaaacaacaatcaccgcttcagaaactgaagcattattgcttgaacataattatattaaagcttttcagccccgttacaatgttttattacgtgatgataaatcctatccctatattctattaacgaaagaacgtcatcctagaattacctcgcatcgaggttcaaaaaaagtacaaggtgagtattttggcccttatccccatgcaggagcggtacgtgaaactctctctttgttgcaaaaattatttcctattcggcagtgtgaaaactcggtatataacaaccgctctcgcccttgtttgcagtatcaaatcgggcgttgcagtggtccttgtattgatggtttagtatctgatgaagaatatcagcaacaggtcgattttgctcggctatttttacaaggtaaagatcagcaagtgttggagcatttgatcaaaaaaatggaacaagcgagtatgcaacttaattttgagcaggcagcttatttccgtgatcaaattcaggcgattcgtgcggtaattgaaaaacaatttgtttctaacgaacgtttagatgatatggatattctggcaattgcttatcagcttggtattgcttgtgtacaagttttatttattcgtcagggaaaagtattaggtaatcgcagttattttcccaaagtgccggcaaatacggatttaagtgaattaaccgaaacgtttgtcggacagttttatttacaggggcatcaaggtcggattataccaagtactattattgttgatcatgttttgaatgaaaaacatgaacttgaggttttattaacagaacaagctggacgtaaagtaaatattcaagataatgtgaaaggcaataaaagcaaatttttacatctggctcaaatgaatgcacaagccgcattagtaacacagcttaaacaagctaatttaatacaagagcgttatcaggcattacaagaacttttgtctttaactaccattaaacgtatggaatgttttgatatcagtcatactatgggagagcaaacaatagcttcttgcgttgtttttgatactgaaggaccgttgaaatcagattatcgtcgtttcaacataagcggaattactgcaggtgatgattatgccgctatggagcaggctttgttgaaacgttatgatcgcccattagaaaatgagaaaattccagatattatttttattgatgggggaaaggggcaattaaaccgtgctttacaagtttttgcacaattaaatgtatcttgggataaaaataaaccgctcttaattggggtagcaaaaggggtagatcgtaaagcaggtttagagacgttaattattagtaaacaaaataaggaagtgaatttactgcctgacagccttgcccttcatcttattcaacatattcgtgatgaaagtcatcatcatgccattggcggtcatcgtaaaaaacgtcaacaggcttttactcaaagcggtctagaagccattgaaggcgttggagcaaaacgaagacaagctttattaaaatatttagggggtatgcaaggtgtaaaaaatgcgactttagcagaaatttcctccgttccgggcatttctgctgcgttggcggaacggatttatgaaacgctaagaagtgaataagcagtaacaaagcaaaaggggaaaatatttaatttccccttgttttatctataaaatcagcaaaatcaaagaatgatgtttccattatcatctgccggttttgttagcccgataataaattcaatgagtgcgataaaaccgggaatgaaagtccaacagaataaaagatataaaatacctaatcccgttttaccggcataaaatttatgaatacccaatccacccaagaaaaatgccagtaagcaataagcaattttattcaccggtttggctgtttgagcataggtattttttgtttttaaaataacaggtgcttcatcagtaccgaatacatcgacttcatctctgacctgtggttcaaaatccaatgctgttcttggtacttctttgatagaaccatcaggcataccaatagacaccatattatcttcaatttttataattttagccataacattccctcttagtgttattagttttaattaattaaaatttttaaaagccaaagaagaaaaatctgaataagagaattttttcattggctcaaaagtgcggtttattgtactcaacctagaattagttagcaatatttccaataatgcttctcgtttcttctttaatgtccacaagttgaacatgaattatatcgccaattttgtatgttttttctcctttaatataaagtgcaatttcctcggcatttacctgaagttcttctctattgctgtgtagggttgatgccggaataaagacggaagctccattttccaatagaagtacacgtaatccgccacgcatgacatcttgtatttcagcttggaatacttgcttttgttccactttatctgctaaatagcgacaatataaccaatctgcaatatctcgctcaactaaacggttttgacgacgagcctcttgtaaacgttgtaagatactatcttgagggcgttcatattgttgtgttgtgagacttgctttaattaggcgatgattaactatatccgaatatttacgaattggagatgtccatgtggcgtaaccttgcaaacctaagccaaagtgcggtgctaattccgttttaaattctgctgaggttaagaaacgacgtaaacgcaattcaagataattattttcgcttgctccaatatcatgacgcatattgcagtatccacttaaggttgctaaattttctacagaatagcgttgttttaattctgcttgattttgttcgctggttaaatttgacagcaggaaatgatgtgcattttccaagaattttttatcgaaaccactatgagtattaaaaatcccaaaaccaattttttcattcagatattgtgccgcacaaatattcgcaataatcattgcttcttcaacaatttggtttgcaatgcgacgatattctgttttgatctcttgtactttaccattttctgccagtacaaaagagtagtccggtttttctttaaacagtaaagcatgagttttacgccattgtgatctagctaaggtaaactcatgtaaccatgcaatttgttgttgagtaacaggatcttgtggttgccaacagcctgttttttgttctaaataatcagacactttatcataagctagtttagctttcgacattacataagcagagacaaagtatggtgtagcggtaatttcaccttgtaaatctgttgtgatataacaaaccaatgcggcacgttgagcattttcggaaagagagcaaagatcgtcggataactctcgaggcaacattggaatattaaatcccggcaagtaattagtgaaacaacgttgtctggcatcttgttcaatttgtgaattaacatcaatataagcagttggatcggcaatcgcaactactaatttccagccgacttgagcttcattttcgttgattggctcaatatataaagcatcatctatatcttttgttgtttcactatcaatagtgatgaagtgaagtgcggtgagatcttcacgatcttgttgatccaacatgtggtaactttcttgtccctgtacaggataacgagattgttcatgatgtgccaaagttacccaccaaggtgcaagttcatcatcagcgtgacaaataaattcagaaatgtgtgcaaagaaaaaacgatcatcacgtaaaggatggttttttagctgtgccacaacccaatctccctcttgtaattcttctttaacggcttttgtttgtgtcgctccaattggttgattaatttgggggtgatcgactacaagttgtaatttcttgtctttattgaaccgcactttggcaataaagcgagttagcatggggtcaatgagttcttccggttcagcttgttctttatcgccaatcgtttcaatcactgctttaattttgtcgccatgcataacttttttcattgccattggcggaataaaataactttttttatcacactcaaggaaaccgaaggctttgtcagaacctcttacaataccttctacatgcggtttactatcacgaatttgttgtttgagttgggaaagtaggggattattttgaaacatattcttacgctataaatgaaaacggatgttcagttgaacatccctagaaaagattaaatgtagattattctgcacctaagtcgcccatggcagtaatgctaaaaccggcatcaacatgcaatacttcacctgttatacctgaagccaattctgagcataagaatgcggctgaattgcctacatcttcaatagttacggtacgacgtagaggggctgtgttttcaaaagtggccagcattttcttgaagtttttaatgcctgatgccgctaaagtgcggattggaccggctgaaatagcattgacacgaataccgtctttacctaagtctgccgccataacacgagttgccgcttcaagagaggctttagctaaacacatcacattatagtttggaatggcacgttcagcacctaaataagtcaacgttaataagccggcgttttgatttaacattggacgggctgcttgtgccattgcaacgaaactgtatgcactaatatcatgtgcaatgcgatagccttcacgagttgccgcattgacatagtcgccgtcaagctgatcacccggagcaaaagcaatagcatgtacaaaaccatcaaacttgtcccaatgctgttttaattgtgaaaaacatgccttgatgctttcatctgttgcaacatccaaaggtaaaacaatagtagaaccaaattcttgtgcaaattcttctacgcgtgcttttaatttatcgtttaaataagtgaacgctaattcagctccttcacgtttcattgccgttgcgataccataagcaatagaacggttgctggccaaacctgtgattaaaatgcgtttacctgctaaaaatcccataataaaaccctttattcggttagttaaaaagtcggcatagtataagtcaaaatgagagaaaaaacaaaagacgcaagagtacgctgatctttaagctggattatcaatatctttaaattcaacttcaaaaccgtattcttgagctagccattcgcctaaggccttaataccataacgctccgttgcgtgatgaccggcggcaaaaaaatgaatgccttgttctctggctgaatggatcgtttgttccgatacttcgccggtaataaaagcatctaatccttttgttgcagccaaatcaatataaccttgcccgccgccggtacaaataccgacagttcggattaagtgcggtgcattttcaccacaaaataagggtttacgccctaatgctttttcaatgcgttgagccaattcttcaccgcttaccgtctcaactaaatcaccataaacaggaatactgaaactaccattttctaatgggcgtaaattttcaatacctaataacttcgcaagttgtgtattgttacccaactctgcgtgtgtatctaacggtagatgatacccatacatattgatgtcattttgcaacaaggttttaatgcgtttacctttcattcctcggatgcaaggattttcatttttccagaaatagccatgatgaaccaaaattgcatcagcttgttgtgcaacagcataatcaattaacgcttggcttgcggttacaccggtaataattttttgcacattggattttccttcaatttgtaaaccgttgggtgcataatcggagatattggcactattgagtttttggttgataagttgctccagttcaagattattcatattgttatccatccaattaaattttatttaatttcagttccttttaataacttacgtatccaactgcgatttgggctgagattatgtagaatatcttcgctcaaagggagtggttccgcataaatcagagaggcaagggtttcacctaataaagcggctgaagttaaccctcttgagcctaacgcaccgatgagatataaatttttccattgtgctgcatcaggaataggctgtttacgacgacgtaaattgaagatgtttcggtagtctaaacattgttgctcaaaatgaggtacattccccataatcggcacacgatcacgcactgaacaacgaacacctattctagctatattggctgatatatcaatatcctgcaaccaatccatgtttttatccgtatcggtagaagctagattttgttgaattttttgctgattttcccgttgttcttgatggctaaaatggcgatctttgttattgcgaatatgacttgcaccaaggcaatgactctgtttcattttatccgctggagttaaatagccatcgtaacaaagtacggatttaagtttcagtaaattttcactggtcggaatttggctgacttgacctcgtacgggataaagaggaagtttagctgtttgcacaaaatctgtaatttgataaccattggcgagtacaacaacttgatgattaaaggtttcattttgttcattggttaaaacccattgtaaatttcggtagtcaagtgcggtaattttttgtgaggttttgatctctaatccaagttgttgtaagtaagaaaaagcattttgcacaaattgacgtggagcaagccaagctccctgcggaataaaacctcctgcacaatctaaaggaagccctattttttcacttaactgctctttatttaaattctgatacaagctttttgaccattgataagaagaaatttttgccaatttaaccgcacttttgtgatcgtaagcacaaagtgctacaccacaaaattcatgttcaaattctataccttgtttaattgcccactgcaattgttgtaaagcatagaaaaaggcatgaacataaaagcgaatattgcgatcatcgtcatcacttaattgaggataaaaagcaccttgtttgttaccggaggcgttgagggcaagttgctcatcttcacaataaagagtgatttttgcccccctttttaatagtgaaagtgcggtgaaaagtgaagcgattccgcctccgataattgcaatgtcttcagaaagtaatgaggcgggctgacttaagtaccaaggggcttttgtattttgttgtggaatagcatttttaataccacataaacattcccgctttttgccgtaaccttttcgtttttgtacttcgaatccggcagaaactaatccttttctgaccgcacttgcagcggtaaatgtggaaaatgttccttgtggcttgctgtaatagaacatctgttgatagagttcatcattccacatttgtggatttttactgggtgagaaaccatctaaaaaccaagcatcaatacgattttgcatataatcacccagttggggcaaattatcgacaatatcaccaaaccataaatccaatgttgtttcagcaaaatgaaaacgctgacaaccttgtatcgcctctaagcaataatcgcataattgttgtgataaagcagaaaattgtgggtaaaattgatgaatttgttgtagttgaactttgggaagagggtatttctcaaaggaaataaaaaataaatgtttaagtggggaatgagaatattgttgccgaaattggcgaaataaacttgttacggcaagaaaatttaaacctgtaccaaatcctgtttctgcaatgacaaaatgtttttcttgatagacaatccagcgttcccataaatgattaccttgctgaaatacgtattcgctttctgctaaaccgtcttggttggaaaaataaacgtcattaaattgttctgataccggtgttttttcttgattcaggtaaattttggcgggcgtaactgtaaacataatatagctaatttttttgttgcattcatgatttttgctataatagcgaaaattttttcactggtcgaacattcgaagaaagacttgaaatattttcattttatagtaagttgacgaccgattattttattctttaacgtaaaggaatgtttctatgagaagagccgtggttacaggttttggtattatttctagtattggtaacaataaacaagaagtgttagaagctttaaaaaaagggaaatcaggtattgaagtgatgccggattttgtcaagatgggcatgcgtagtcatatagcgggaacaattaaattaaaccctgctgaattaattgaacgcaaaattttccgttttatgggagatgctgctgcttatgcttatctctcaatgaaagaggccatcgaagatgctggattgacggaagatcaagtttccaatgatcgtactggacttgtcatcggagcgggaacaggatccggtcataaccaaatggttgcttgtgatgctgtaaggggtccaagaggcgttaaagctattggaccttatgcagtaactaaaacgatggcatctagtgtatcggcttgtttagcaacaccttataaaatccgtggcgtgaattattcgattagttctgcttgtgctacttctgcacattgtattggacatgccgtagaattaattcaattaggtaagcaggatgtggtttttgccggtggagcggaagaattatcttgggaatgtgcaactgaatttgatgcaatgggagcggtttcaactaaatacaatgaaacacctgaaaaagcttcacgtgcttatgatgctcatcgtgacggatttgtgattgccggtggcggtgcggtagtcgttgttgaagaattagaacatgctttagctcgtggagctaaaatttatgcggaaatcgttggctatggtgctacatctgatggatacgatatggttgcaccgagtggtgaaggtgcggagcgttgtatgaagcaagcattggcaacagtggatacgccagtggattatattaatgtgcatggtacgtctacacctgtcggagatgtaaaagagttaggtgcaattcgcaacgtatttgctgatcaaaaacctgccatttcttctacgaagtcaatgacggggcattcactaggtgcggcgggggctcatgaagcgatttatagcttattaatgttagaacatgattttattgcacccagcattaatattgaaactttagatgaacaggcggtcggtatgaatattgtgactgaaacaaaagagaacgcaggtcttgaaactgttatgtcgaacagttttggtttcggtggaacgaatgcctgcttggttttcaagcgttataaaaaatagagataattcttttatagtgatctatctaatgatttagacagatactgttcttttagatcttattttaaagaactattttagatattgaagtgagctgcctctaaaagttggacggaataaccaactgattagaggcagatttttatgattaaatgcaaaacaacaaactactgagtagtctttttatatttttagaatttgttttatattaaaattatctctttatctttaaataaaaatttaataaatatcaagtttaatgaatataatttttaataattgttattttgataaatttaatttaatgatattatcttaatgctttaatatggaaggttaaatcctgaaaagcaaagtattgaatacgatgttgctattaagcgaacttttatacgcatgaaacaggtcgtggcgtcttttgattttttattttattgatgtggttattatgaaaaaatttattttactcggattattactttctttttcttcatcaagcattgctgagttatctgattggattaagccgatttcggatatctcctccggagatactgcatgggtgatgatatctgcaatcttggttttatttatgactatccccggtttggcattattttatgggggaatggttcgtaaaaagaatgtgctgtcgacaatggcacaaagttttgcggtaagcggtttgatagctgttatttggttgtgttttggttatagtctttcctttacaccaaataatgcttttattggcggaatggatcgtttttttctgcaaggtttaaatgtgtttactgaacagaaaatgcttactgtttatcctggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtagcaggattagtcgctgcaattgtcattggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattagcaactactcagatttcagcctcggtcggagcattaacttggatattagtcgaagtattttgtaaacacaagccgtctgcgttgggtttggcatcaggagcggtagcagggttggttggtattacgcccgctgctggttttgtatcggtacaaagtgctttattcataggtatgataacaagtgcggtctgttttgtcggtgtaatgaaactcaaatattggtttcgatacgatgatacgctcgatgcgtttggtattcacggtttaggcgggattgtcggagcggtgttgacaggcatattcgtatctcctgatatttcagccaccgaaaccacactttggacacaaattgagagtgtattaattactatcatttttagtgcctcaggtagttttgttttattaaaaataattgacaaaaccgtagggttacgagtggagcgagatgaagaacgtcaaggtttggatttaagttgccatggtgaaagaatagaatagttaaaaaatgaccgcactttacgctttataaagtgcggtcagattatagtagctatatagtttgaagatgaaattcgaacacctattatttggcgttaattaaataatttttccctccagtatccaaattcttttaacaattgtgagtttatattcaaagaaattgcttgtatttgtacttaaatcgtgaagttagtcgttgatggttgtagaaaaaataaaagttacattctaaaagaagatccaaaatttaaacacgcaatagatagttttgaatggacagcttagccttgtggtaggggcttgccctcgttctctgttttttgctatcaacctattttcaggtaaatacagagaacccttctcgactagtttggatttaccgagtaatcaataagggaatatgcctgaaaaaatggttcatttcttaattgttagcatactattatcaagctgcatgagtactgctataaaattttaggataatttaggataataatgggggaactctctcaaaaagaagccaaaatttttgatcaatgtcaggagggggtaatcaattaaaaagtaataacagatttaaccattaacttttaatttacggagatatatgatgaacagcgtgaacaattcaattttttaacgaactaacccattcgtcaaatgtaatatcactcaaattaagaattttgaaaaagatttttcaatcaaaagtcctgaagattatagaaattatttatgctatttaataatagcggagctagtgttcatcatatgtatggattgcataattatgagacatgtagattttgaatggaaaaaggcatgttggagtatgaacaggggactttagatcggttattatgatttggagcgggaaacgaggctcgaactcgcgaccccgaccttggcaaggtcgtgctctaccaactgagctattcccgcatattcctaaagaacggagcgtattatacaaatattttactaagaagcaaggttaaaatttaaaaaaacgcaaccttgcttgattattggttgaattaattatctgtttgttaagttaataaaggtattcctataatgagctaattcagcaatggattcacgaatatcatctaacgccaaatgtgtgttctttttttcaaagctatttagaatttcaggtttccatcttgatgcgagttcttttagtgtgcttacatctaaatgacgatagtgaaagtattcagctaattcaggcatgtagttgattaaaaaacgtttgtcttgagcaacgctatttccacaaataggagaaacacctttaggaacccatttttttagaaaatccaaggtttgtaattctgcagcccgttctgttaatttgctgttttttacccgttcgattaagccgttagatgtatgagttttcacgcaccattcattcatgttattgagaagttcgtttgattgatgaatggctaaaacaggaccttcagctaaaatattgagatctttatctgttacaattgttgcgatttcaataatccgttctttatcaggatctaagcctgtcatttccaagtcaatccaaataagattttgtttatctaattgcataataagagtatcctatacaaaatttcttatattctaactgaaaaatgaccgcactttaaggatttctctttgagcaaacgtaaattaacccaaaatcaacaacgtcgaattcaatctaataatgcaaaaacattacatcgtcatcaacatcggcacaaatcagatattgattggcaagatgatatgcttggtgattttcaagatggaacggttgtgacaagatatgctgttcatgctgatgtagaaaatgaacaaggtgaaattgttcgttgtaatttacgccgtacattgaaaagtgtcgttgtgggcgatcgtgttgtttggcgtaaaggaaagacacaactacaaggtgtaagaggggtcattgaagcggttcaaccacgacataatcagattgtacgcccggattattatgatggcttaaaatcgattgcggctaatattgatcgaattattattgtttccgccgtattaccaaatttatctctcaatattattgatcgttatttagttgtttgtgaaagttcgaatattcctgccgttattgttgtaaataaagcagatttattgagtagtgaagctcgaacagaagttagcttacaactcgaaatttatcagaaaataggttatgaaacgttattaatctctgccaagagcggtgaaaatatggataagctaaccgcacttttgtctgagggaacgtctatttttgttgggcaatcaggtgtgggtaaatcaagtttaattaattatattttgcctgaagtgaatgcacaaactggtaagctcagtcaagtatctggtctaggtcagcataccacaacatcttctcgcctatatcacttatcacaaggaggaaatttgatagattctcccggtattagagagtttggtttgtggcatttagagcgagatcaaatcacgaacggttaccgagaatttcagtattttttgggaacttgtaagtttcgagactgtaaacatttgcatgatccggggtgtgctattcagcttgcagtgaaagaaggaaaaatcgatcctttacgttttgaaaattatcatagactaattacaagtttgtccgaaactaaatctcaacggcattttatatcggcgaattaagttaaagaagatattttgtatacttaataaacaacttggagctttttttgtgatgtagttcaaattttaatgtggtttaccttgattattctgatttgaaacttgatactatgcgtctgatttatttttttatttaaaataaatatgaactgacactaacgaattgtttttgaagcgttaggatactacatgtagaatgatttaaattaagaggatacagttatgtactcaaaagatgttgaaattactgcaccaaatggtttacacactcgtccagctgcacagtttgtaaaagaagccaaagcgttcgtttctgatattacagtaacttcagcgggcaaaagtgctagtgcaaagagtctatttaagttacaaaccttgggattgactcaaggtacagttattacgatttctgctgatggtgaagatgaacaaaaagcggttgaacacttagttgcattaattcctactctagaataatcaatatatttattagccataacttaatgttttcataaataataagtttatggctattgtgttatttagcgtattgtaatttaaaattattttggaaggttaatatgatttcaggtattacagcatcaccaggtattgtatttggtaaggcactggtgcttaaagaagaaaagattgttcttgatacgcaaaaaataaaagatgagcaaatagacattgaagttgctcgtttttatagcgggcgtgcggcagctatagagcaattgattgcgattaaagatcgtgctttagtctctttaggtgaggaaaaagctgcaatttttgaaggacatttaatgatccttgaagatgaagaactggaagaagaaattttagattacttacgttcaaataaggtcaatgcaggcgttgctgcaagtaagattattgatcaacaagttgctatgttgtctgaaattgacgatgaatacctacaagagcgtgccggagacattcgtgatattggtaatcgtttgattaaaaatattttaggtatgaaaatcgttgatttaggggatattaatgaagaggctattttggttgcttatgatttaaccccttctgaaacagcacaattaaatttggataaagtattaggcttcattacagacattggtgggcgaacatcacatacttctattatggctcgttctcttgaattgccggctattgtaggaaccaatgatatcacttcaaaagtcaataccggtgattatctcgttcttgatgcggttaataatgcgatttatgttaatccgacacaagaagaaattgagcgtttaaaagctttagaacgacaattagctgaagaaaaagcggaattagctaaattgaaagatttaccggcattgactttagacggatatcaagtagatgtggtagctaatattggcactattcgtgattgtgagggagctgatcgtaatggtgctgaaggcgtcggattatatcggacagaattcttatttatggatcgtgatcagttgccaacagaagaagaacaatttattgcttataaagaagttgttgaagcaatgaatgggcgtttagttgtgttacgtacaatggatattggtggagataaagatttaccgtatttgaatttacctaaagaaatgaatcctttcttaggttggcgtgcgattcgaattggtatggatcgtcgtgaaattttacatgctcaattacgtgcagtattgcgtgcgtcagcttttggtaaattagctgttatgttcccgatgattatttctgttgaagaaattcgagaattgaaatctgtgattgaaagtttgaaacaagaattacgtgatgagggtaaggcttttgatgagaatcttcaagttggggtaatggttgaaacaccggcggcagcaataaatgcaaaatttttagcaaaagaagtagatttttttagtatcgggacgaatgatttaacccaatatactttagcggttgatcgtgggaatgaattaatttcacatttatacaatccgatgacaccggctgtattaaacttaattaagcacgtgatagatgcatctcatgaggaaggtaaatggactggaatgtgcggtgagttagcaggcgatgaaaatgccacattgttattgttaggtatgggattagatgaatttagtatgagtgcaatttcgatacctcgtattaaaaaattgattcgcaatgtgaattatcaggatgctaaattacttgctgaacaagcattacagcaaccaactgcggcaggtattttgagcttagttaatgattttttagtggaaaaagcacttaattaatatcatttgataaaaaattacgctagaatagtgcaattattcatgagtaggagaaagtttaaatggctttttttgataaattatttggttcaaaggaaagcaaatctattgatgttgaaatttatgcacctatatcaggtacaattgtaaatattgaggatgtaccagatgtggttttctctgagaaaatagtaggtgatggcatagcaattcgtcctacggggaataagattgttgcacctgtagatggagtaatcggtagaatatttgaaactaaccatgcattttcaatagagtccaaagatggcgttgagttatttgttcactttggtattgatacagtagaattgaaaggtgaaggttttactcgtattgttcaggaaggtcaacaagtaaaacgtggtgaaacaattattgaatttgatttggcttcattggaagcaaaggcaaaatcagtattaactccgctggtaatttcaaatatggatgaaattaatagtatggataaaatgtctggcgaggtcgtggctggcgagtcagttgtactcttgttgaaaaaataatgaatagtgttatttaaaacggattggtagtggctaatccgtttttttatatcaataaatttttaaggaagaacagcatgtgttttttctattttcatataaaaactactatctttatttcaaaaaatctaataacatttacgaaatttgttaagatttgtggcgtaaactagatttgattagtttcgttgtgagttttgctaacattatcagaattttagttatcaatccattgtttaatttagtgttataaattaaacgtaccttttaacttaacacaataaggaaaagactatgtcagatatattgaaaaatgacgtagatccggtcgaaaccaatgattggttattagcgatcgattcagtaattcgtgaagaaggtattgagcgtgctcaatatattatagaacaattgatgcaacatgcccgtgcaaattctgtgtcattaccaacgggtgtaagcacagattacattaacacaattcctccatcagaagagcctaattaccctggtaatttagacttggagcgtcgtattcgtagtgcaattcgttggaattcgataatgatggtattgcgtgcttcgaaaaaagatctggatttaggtggacatatgtcttctttccaatcttcagcaactatttatgaagtttgttttaaccatttctttaaagctcgtacagaaaaaaatggtggtgatttagtttttttccaaggtcatatttctccgggaatttatgcccgtgcattcttagaaggtcgtgtaacagaagagcaattagataatttccgtcaagaagttgaaggcaaagggttaccttcttatccacaccctaaattaatgcctgaattttggcaatttccaactgtatcaatgggacttggaccattgaatgcaatctatcaggcacgtttcttaaaatatttacataatcgtggcttgaaagatacttcagagcaaactgtttatgcgtttttgggcgatggtgagatggatgaagtagaatctcgtggtgcaattgcgtttgctgctcgtgagaaattagataacttagtttttgttatcaactgtaacttacaacgtttagacggtccggtaaccggtaacggtaaaatcattcaagaacttgaagctcaattcaatggttctggttgggaagttattaaagttatttggggacgccgttgggatcgtttattacaacgtgatacatcaggtaaattattacaattaatgatggaagttgttgatggcgattatcaaactttcaaatctaaagatggtgcttatgttcgtaaacacttctttggtcgttatcctgaaacagaagcattagttgcggaaatgacagacgatgaaatttttgcacttaatcgtggtggacatgatccattaaaagtatttgcagcatttaataaagcaaaacaagttaaagataaaccggttgtattattggttaaaacgatcaaaggttatggcatgggagaagcggctgaaggtcgtaatatagctcatcaagtgaaaaaaatggatatgtcaggcgttaagcatgtacgagatcgtttcaatgttccggtatctgatgcagaaattgataacttaccttatgttaaatttgcagaaggaacagaagaatataaatatcttcatgaacgtcgtcaagcattgaacggttatttaccgactcgtttacctcgctttacacaacaaatggatgttcctgcattagaagaatttgcacaattatttgaagaacaaagtcgtcctatttccactacaatggcatttgttcgttcattgaatgtattactgaaaaataaatctgtaggtaaacatattgttccgattattgctgatgaagcccgcacttttggtatggaaggtttgttccgtcaaatcggtatttataacccgcatggacaaaattatactccgcaagatcgtgaacaggtatcttactatcgtgaagcaattgatggacaagtattgcaagaaggtatcaatgaacaaggtgcaacagcatcttggttggctgcagcaacgtcatattcaacaaatgatatgccaatgattccattctttgtgtattattctatttttggtttccaacgtgtaggtgatttaatgtggttagcaggcgatcaacgtgctcgtgggttcatgattggtggtacttcgggacgtacaaccttaaatggtgagggattacaacatgaagatggtcatagccatattcaatcttctgttgttccaaattgtatttcttatgatccggcttttgcttacgaagttgctgttattatacaagatggcgtgcgtcgtatgtatggacctgaacaagaagatgtgtattactatatcaccacactgaatgaaacttatgatcaacctgcaatgcctaaaggtgcagaagaaggtattcgtaaaggtatctataaatttgaaacagtaactggtcaaggcaaaggtaaggttcagttattaggttcagggtcaattttacgtcatgttcgtgaagcggctaaattacttgctgacgatttcggcgttacatctgatgtgtacagtgttacttcatttactgagcttgctcgtgatggtgcgaatgcggatcgttggaacttattacatccaaaagaagaagctaaagtaccttatattgctcaagtaatgaatgacgctccggcaattgcttcaacagattatgttaaactatttgcagaacaggttcgtccatatatacctgcacaaagttatcgtgtattaggtactgatggttttggtcgttcagatagtcgtgaaaatttacgtaaacatttcgaagtaaatgcacattatgttgttattgctgcgttaaccgagttggcacagcagggtactatcagtaaagacgtagttgctcaagcaattagtaaatatggtattgatgcagataaaatcaatcctttatatgcataatcaatatttgaactgagcggatataatccgctcataaaaaaaggataagataaaatggctaaagaaattcaaattccagatattggtggagatgaagttactgttactgaagttatggttaaagctggagatactattatagttgatcaatctgtgattaacgttgaaggcgataaggcatcaatggaagttccatcaccggaagcgggtgtcattaaggaagttttagtaaaagtaggcgacaaagtttctactggaactccaatgtttgtattagagaatgcagaattagcatctactgagacagcatctgaaagtatgcaaaccgaaaaaacacaaagtgcggtagcgtctatcattgaaatttatgtacctgacattggtggtgatgaagtcaatgtaactgatattatggtttctgtaggtgagacagttgcagaagagcagtctattttaaatgttgagggtgataaagcctcaatggaagtgcctgcccctactgccggtatagtaaaagaaattttaatcaaagtgggagataaagtgtcgaccggttctcttgtgatgaaatttgaagttgcaggtgttgtatctgcagccgaaacagctcaagtttcttcttcagctgaagtaacaggtgaaagtgcggtgcaagatgtacacgttcctgatatcggtggtgatgaagtcaatgtgacagaaattatggttgcagtgggcgatagtgttacagaggaacaatctttaattactgttgaaggtgataaagcttcaatggaagtgcctgctccttttgctggtgtagtgaaagaaattttggtgaaatcaggggataaagtttcaactggttcattaattatgcgttttgaagtgcaaggaaaagcccctactctagaagcatcatcggcggtgacagagactaaagtggctccatctccagctgcacaagaaaatcaaatgacgccagtgtctcaagctgatgtgactgcaagtgcggtgtttgctcatgcaactccggttgttcgtcgtctagctagagagttcggcgtgaacttagacaaggtaaaagggacgggtcgtaaaggtcgtatcttaaaagaagatgttcaggcttatgtaaaagcggcaattaaagcggttgaaagtggcaatgtttctcctacatcagcaggtaatggtgctgtcaatggagcaggactaggcttgttaccttggtcgaaagtcgacttcagtaaatttggtgatattgagcaagttgagttgggtcgtattcagaaaatctccggtgcaaacttacatcgtaactgggtaatgattcctcatgttacgcaatgggataaagcagacattacggaactggaaaaattccgcaaagagcaaaatgtgttggcggaaaaacaaaaacttgatgtaaaaattacgccattagtatttattatgaaggccgttgctaaagcgttagaaaattacccacgctttaatagttcattatcagaagatgctcaaagcctgattctgaaaaaatacattaatattggagtggcggttgatacacctaacggcttggttgtacctgtgtttaaagatgtgaataaaaaaggcattattgaattatctcgtgaattagcggaaatttctaagaaggctcgagctggtaaattaaccgcatcagatatgcaaggtggttgttttactatttcaagtctaggaggaattggcggtacacactttacgccaattgtaaatgctccagaagtcgcaattttgggcgtatctaaatctgaaatgacaccggtatggaatggcaaagactttactcctcgcttaatgcttccgttatctttgtcttatgatcatcgtgtaattgacggtgctgatggagcaagatttattactttcattaatagtgtattaagcgatcttcgtcgtttagttatgtaaatactacgcctctaaatcttattagggggcgttaaaactgttaaagtgcggttgaaaaccgccaacttttaacgaggtaaaaaatgaataaagagattaaaacacaagttgtcgtcttgggagcaggtccggctggttactcagcagctttccgttgtgcagatttaggcttagaaactgttattgtagagcgattttcgacgcttggtggagtatgtttaaatgtaggttgtattccgtctaaagcgttattgcatgtagctaaagtgattgaagaagctaagtccttatccgctcatggtattgtttttggtgaaccaacaacggatattgataaaattcgtggttggaaagaaaaagtaattaatcaattgactagcggtttagcaggtatggctaaacagcgtaaagtacaggtagttaatggttatggtaaattctcaggaccaaatgcaattattgtggctggtgatgaaggtgaaacgaaaattacttttgataatgcaattattgctgccggctctcgccctattcagttaccatttattccacatgaagatcctcgtatttgggattctactgatgcgttaaagttaaaagaagtacctgaaaatctcttaattatggggggcggtatcatcggtcttgaaatgggaacggtttatcatgctttaggttctaaaattgatgtggttgaaatgtttgatcaagttatccctgcagcggataaagatatggttcaaatttatactaaacgcattgaaaaaaaattcaatttgttactggaaactaaagtaactgctgttgaagcaaaaggagacggtatttatgtatcaatggaaggtaaggctgcaagtgaaactcgtcgttatgatgcagtattagttgcaattggtcgtgtaccaaatggtaaattaattgatgcaggtattgctggcgtcgaagttgatgatcgtggctttattcgcactgacaaacaaatgcgtactaatgtacctcatatctttgctattggtgatgttgttggtcagccaatgctagcacataaaggcgtacatgaaggtcatgtagctgcagaagtaattgcaggacaaaaacattattttgatccgaaagttattccatctattgcttataccgaaccggaagtagcttgggtggggaaaactgaaaaagaatgtaaagctgaagggattaattacgaagttgctaagttcccttgggctgcgtctggacgtgcaattgcatccgactgtgctgatggtatgacgaaattgattttcgataaagatacacatcgtgttattgggggagcaattgtcggtactaacggtggtgaattgctaggtgaaattggcttggcaattgaaatggggtgtgatgctgaagatttagcactaacaatccatgctcatccaactttacatgaatctgttgggctagccgctgaagtttttgaaggctctatcacagatttacctaacccaaaagcgaagaagaaaaaataataatctagctcgctgagacaataaggcgatcttttatgagatcgccttatttttttgcaaaaaagtgcggtaaaaaatacggcactttttaggcgacaaattttatttgattttcttttggttttatttgatggattgtattggttactgtaccaataataggcaaagtttgccaattagatgttcttattgaatgtactttattatctagtgggaaaaaaataaattcattattttcatgcatcatgaattcataaatttgaaattggttattaagatctaaaacgacaagatcattcattgaaaggtaattttgtttttctacaataagaatatcaccttgctcaatattccaagcgagcagattaggattgttaacttgaataaaacaagtttgttgtgggtgtttaatacagtaaagattgagatctagttttttgtgtgaacttctattacgttcctcaatatcaatgaagaatggcataggttggtaagaaagtgtagtgtttatattgctgatattctgatttgcgtaacccatctttttctccaatctaagtatgttatatattaactgattatttatacaggtatatattactgtttttatatacatatggtcaatagcataatagaaatttttagaaatttgcagattaataaatgtattttattttataaaaattcaaaaaatgtttattttaatattttctttataatcaatttacgttatctttactaaaccttggtggatctatagatctgtatttttaactcaaaaaacacaacatttattattatgaataagtcatatttatactctttcttttttcatggaagtttggtcaagcgaatttctgttggtcttttattgggattgctgttagcattaattgctccatcattgcaaggtgtattaggttttaatcttgcagaaaaagccggttttttaggaaaaatatttgtgcgttcattgcgtgcagttgccccaattttagtttttttattggttatttctgcaattgctaataagcaattaggcacaaaaagcaatatgaaatctattgttgtcttatatttgctaggaactttcttagctgcattgacatcagtattatttagttttgcattgccgacagaaattgctttaaaaacgcaagaaggctctctttctccgccaaacgaagtatctgaagttttaagtaccttagtactgaacgtggtagataatccaattaatgctttatttaatgcaaactttattggtatcttattttgggcaataggtttggggatagccttacgctatgcgtcagatacgactaaaaatgtcatgaatgatttttcagaggctgtatctagaattgttcattttattattagttttgcacctatcggtgtttttggtttggtggctgaaactttaactgataaaggtttgggtgcattgcttgattatatgcaattactagttgttttaattgggtctatgctatttactgcatttgttattaatccaattttagttttttggaaaattcgtcgtaatccatatcccctagtatggacttgtgtacgagaaagtggattaacggcattccttacacgtagttctgcagcaaacattcctgtaaatatggaattgtcaaaacgcttaaaattagatgaggaaacttattcagtttcaataccgttaggtgctaatatcaatatggcaggtgcggcgattactattacggtattaacattagctgctgtacataccttaggtattgaggtctctttccctacggctgtattgttaagtgtagtggctagtatttgtgcttgtggtgcttctggtgttgctggcggatcattattattgattccattagcttgtagtttatttggtattcctaatgatattgcagcacaagtaatcggcgtcggtttcgtcattggcgtattacaagattcaacggaaactgcattaaactcttcaacggatgttatttttacagctgcggtatgctggagtgaagaaaataaaaattcatagagtttatctaatgtgaaatatagcgggtatgggtacatatccgctttttcattatacttgatagccttctgcatgaagtgataaagtagaaaaaatttcatctacgatgagaatgctttagcatcactgtactttttgctttgaaatggagatatccctctcataaaaacactatagttttcataagaataagttattttcaaaatatactaataatccatatggttattaatttttacaaaaactttctgttcaataatttaaaaaagaggaatataataggatacactagtttaatagtcaggagagaaatatgtatatcagtcggaatatggaacaatggaatgaatttcttgatttaatgagaaaagcatttgaacaaggcaaagaacaagaactacttactttgctacttactgctgatgagcgagatgcagttgcactacgcgttcaaattgtatcccaattactggataaatctttggcacaacgagagatacaacaaattttgaatacaagtgcggcaacaattaccagaggttcaaatatgattaaaattatgccacctgaatttatggactgggttaaacagcaactaaaccataacaataaaaacgaattaggtagcgattaataaaagggtagtaagagtgagactttaagtcatttttgtttactattttcctatacaaatgcacttctaaacagaaaacagtctttactataaaaaatttacgtcaaaaaaatctgacagtttcatacttaaagagaacactgccagatttaatttactgtatagtatgatgattatgcgttattaccagtgattttagccacttccgctgcaaaatcttcttcaactttttcaataccttcaccaacttctaaacgaataaagtttgttactgaagtattaactgattttaagtaatcaccgacagaaactgaaggatccataacgaatgcttgaccggttaaagacacttcaccagtaaatttcttcatacgaccttcaaccattttttcagcgatttcttttggtttgcctgagttgattgcaatatcaatttgaatttgacgctcatgttctacaacttcagcggaaacatcttctggatttacgaattcaggtttagaagctgcaacgtgcattgctacttttcttaattcttcttctgaaccggatcccgctactaacacaccaatttttgcaccatgtaagtattgagcaattacatcaccctctaaatactgaacacgacgaatcgtcatattttcaccaattttagcaactaacgcagcacgcttatcttcaaaatgagttgctaaggtatcaatcgttattcctttgtttgctaaagcgtaatcagcaacttcatcagctaaacctaagaagccggtatcttttgctacaaagtctgtttcacagttcagttcaactagaacaccaaaaccggaaccaatgcgtacacgaataacaccttcagcagctatacgacctgctttttttgcagcttttgcctgtcccgatttacgcatattgtcgatagccagctcaatatcaccatttgcttcaactaatgcttttttacactccatcatacctgcaccggtacgttcacgaagttctttaactaatgctgctgtaatttcagccatcttaaattcctctatccatttgattaaatagtatcggttttagaccgcactttatcgatataaaaagcagggaactaaaagccccctgcgtttaattaataagggcttacgcctttactgaattattctgctgctgcaaaaacttcttcagttaccgtttcttgattacgaccttcttttactgctgcggtagctgcagaaagatataattgaattgcacgtgatgcatcatcgttacctggaataacaaaatctacgccatctgggcttgagttagtatcaacaattgcaaatacagggattcctagattatttgcttctttgattgcgatatgttcatgatctgcaccgatcacaaaaattgcatcaggaagaccgcccatatctttgataccgccaagacttaattcaagtttttccatctcacgagtacgtactaacgcttcttttttcgttaatttatcaaaagtaccatcttgagattgggtttctaaatcttttaaacgtttgattgattgacgcactgttttccagtttgtcaacatcccgcctaaccaacggtgatttacataatattgctgacagtctaacgctgctgctttaacaacttcagaagctgcacgttttgtaccaacaaataaaattctgccgttattactcgcaatacgagttaattcaactaacgcttcattgaacattgggacagttttttctaagttgatgatgtgaacaccattacgaggtccgaaaatgaacggtttcatttttgggttccagtaacgagtttggtgaccgaagtgaacgccagcttgcagcatatcacgcattgaaacttgtgccataagataattttccttttgtttggggtttagcctccacatatcaagcaaatcgaccgtttggcaccccgatttacttctcatgatacgtgtgtgatttcgtaagttaattgttaaattgacaactcaaaataacgtcgcactttataccacaaagtgcggttaaaaactagaagaaactcttaaattttgcaaaaaaataatgcctgataacctcaggcactatttttacaattcgaagaaatgtaaacctgcttttactcttcattaatgaattttgtattaatttcaatactggctttttctcttaaggcttgaataagcaaattgcttaaactaaattgcttaatttttgctatttgaacgccaaataattgtttttgctcaggcgttaattggctatcttctacgttcattaactcaacaaaaacaatatctccaaacatatttttcgctacagatatggttgttttgcccgggtcaggttttttcattgagaatatcactttgcctaaaacaggatctttattatctgcctctctataaacccacgtttctttttctgaaaaatgaatataagacggtaatttgaaatcagttattgtattcatctctgtaacgattttctctgccatattaaacaacgtagtttcggctttctgacgttttaaataagtttcaatatctgctgttgcctcagctagtgtacgaatcccctcaggtttataatcaactacacgcagaagcacggaatgttgatcgccaacattgattgcctctgagtttataccgccttgcataagatcagaattaaaaatggcggtagcaatatgactataatttaattctggcggtaaatcttgacgagaaaaataatctgtttctttgatgtcaagcccagctactttagctgcttcttctaatgattgcgggttttcaaacgccttttcattcatttgtttttctaatgaataaaaagcatttgttactaaatcattacgcaatttagttgcaatttcctctctaacatcatttaattcacgggttttcatatccaatactttaatgatatggtacgcattatccactttcacaggttggctatactcaccaacatttaataacgtcaccgcactttcaaaagcaagaggcatcattccattcacaacccaatccaaatctccacctttttgggctgataatgtgtccattgaatataattttgctaaagcagcaaaatcttcgccattttgtaaattagcatagactgattgtgcttcttgttcagtcggtaattgaatatgagctaaatgttttgttatatattgagctttattatcttgataatattgtgcaatttctatatcggagatttttactttctgatccgcaatcgcacgagttaagtctagatattgcactttaactctttcaggtacagcaaagttagctttgttagcttgataatattgttcgatttcttgctccgttacagtttgtttttgcatttcgtcatctaaagatagaacagctaaacgaacatcacgacgttggaaaaaattctttgctaattcattgagttgtataggaacctgaaaatcactatttgcaataccttgctgtaattgctctaataccaagccttcacgcacatatgcagcataagtatcagaactaataccacttgaagctaatatctgctgataaattttattgtcaaatttaccatcattttggaacataggtgagttcacaatagctaaacttacttgcttatcgctaattcctaacttaagttcttgtgcatattgacgtaataattcttgattgattaaacgatcgagaacttcatgtcttagatgtttagctgccgaatctgcaacttcagcaaatttagcccctaaattttcacttaaacgttgatattcattgttatattgctgtagaaaaacttgttgagaaatttcttcgccatttacttttgctacagatgtatctgtccgtataaacatataacctgctacgccactgagtacaaaagaaaccccgattaagccaaaaataattttagaaactataccgctagaggcattgttcaatttttccattaacattgaagaaatcctataaatgttagattaaaaagaaatgcgtaaaattataatcgaaagtaactcaattcgcacgattaaaataataattcatcaacaaaacactttattttatagattgaatgaattctgtggcagtgcataagatacggtatcttagaattatgataaaaatatttaactgagctaaagtagtttaaaagtgcggtgctaattcatgacttttacgagtcatacataaaaaaagagtggatttcccactcttttattaaaaaacaaagtcttatctttttatcattcaaccactaaagcacggcaagtagtcgtaccatttgatgttaagtggtctccttgagttaataaaaccaaatcaccggaaactaaataacctttatcttttagcgattgtatggctgcttttaatccttcaagcgtacgactatcctgatcaaaatgaattggaataacaccacgatacaatgcacataaatttaatgtactttcatttcgagaaagggcaaaaattggtagtccggaactaatgcgagacatcaattttgcagtatgaccactacttgtcattgcgatgatggctgcaacacctttcatatggttggctgcaaacatcgtagacatcgcaatagtttcttcaatcgtatcaaattctttatctaagcgatgccgagaaatatttacactaggcattttttcagcacctaaacaaactttagccattgctgaaacagtttctgaagggtattgacctgctgctgtttccgcagaaagcatgacagcatcagtgccatctaatacagcattggcaacatccatcacctcggcacgagttggcataggattgctaatcatagattccatcatttgtgttgcggtaatcactacacgatttagctgacgtgaacgacgaattaattttttctgtattccgactaattccggatcaccaatttcaacacccaaatcaccacgagcaaccataattacatcagaagctaaaataatatcgtccattgcctcatcatcaataacagtctccgctctttcaactttagccacaattttggcttttaaaccagcttgttgagctaattcacgagcataatttaaatcagcactggaacgagggaaagaaacagcaagataatcaacaccaatacgtgcagctaaaataatgtcttctttgtctttttctgtcagtgcgttagcagataacccaccacctaatttattgatacctttattatttgataatggaccgccaacaattacttctgtaaatactttagtattgtctgtcgataacacttttaactgaacacgtccgtcatccaataataaaatatcgcccggaacaacatcttgcggtaatgttttataatccagtcctactgcttcttgattaccttcacctttgggtaaatcagcatctaaagtaaaattatcaccaatatttaagaaaattttaccctctttaaaagtagatacccgaatttttggaccttgtaaatctcctaaaattgcaacagttttacctaactttttagcaatttcacgaactttttcagcacgagcaagatgatcttctggtgtaccatgagaaaaattcatacgaacaacatttgcaccggctacaataattttttctaaattattacctcgatctgtggatggtcccagtgtacatactatttttgttcttcttagtcttctagacattcgttactccgtttaattattttgaataatataagattattaatttagtaaaacccgctcattatatgcttaaaataaaattagatcgagatcacattttggaaaattcttattatagctggataatggaaatgaatattcagattttttctctttttcttttcatgactgttgataaagtaagacttttatatattctttaaaaactttgttaatcatcaaccgcaccaacacacaaaaaaagcagtgattgctcactgctttttcacggtcattgaatgaaacctaccaggtccagccaacccctacaccaccgccgaaatcaccggcagagtttctgctaccatgtaatttcagcattattttaccattatcgctcaaacgcgaataacctaatgccaccgcattgtttcctttataggtacccgcagataaagcaaggctcgatttgcccggcatcgttactgtaggcaatgcggcggcagcatgtgctccagcaaccccggctctcaagtctttattgaatatctcaattttattgtcgagatggttgaatttttggtcagtatgtgtctgcaatctctcgacatatcccttgttgaccacggcattcggcgatgagttcggtgttaaatcaggcacacggatttcaccttttgcaccgtcaatctcaactttctgaccttgtccgtttgtgaacgtcaatgcacttgatgtcaaagtagccttgttattaccttctttgagagtgatcccccccgaaccataatgtgcagactgattgtttttacctgtcactgtcaatccgttgccgtcaagacgggatttattcccctctgcggtttctttggtttcaaacgaggtcatatttttcaaggtatcggacaacttcacttccataccgctgtcagaagcagtcactttaatattgctggcagcggttgttgcactgttaaactcgccctcgcctttgatgatcaatttctcgcctaaatttttatggacaggcacgccgtcattgccctcaaaatttaagcccgcttgwcctaargctttcamrtcttgcaagtttgccccacggtgaacatcaacgctggaatcacccgacaacaacttattgactgcgtcatcttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacatctcgcccactttcgtcgccaccgctttagcctcggttttcactgcttcgcccgcatttttcacgttttcagcttgctcttttgctttatcggcatcaatayccaamccgctwgccacgttgcccagcactacaggtttatcggtttcaccaccggtattgaccagagaaagttgcgtatctaccgcacttttatccgctttcggtgtaccgttatcctcaacgtcttcggctttatagtacttaccatcattggctttgactaatctattgccttgattatctgtaaatacgaccgttcccgcctcgccattgcgtaaagcgttcgctttgtcgttggcatttttgccatttaaaccgtctttgccggttaagcctttcgccgccatcgattctttgccgtctgatgttttttcaaaacctgacaatccatctttaccgtccgcaaagaccattatcttcggttttggagcagtttcagaagaatttggattatcaatccatttcgcccctgtagctttgacaagctgtccaccattgatcgcatctttggagtcagtcgataacttgccatcagcaatattgcttacaaccatggcttttggctcagccttaatcacgacctcgctttgtttgtccttaatagacgaaacaacatctttgccatctttggtgtatttaccgcttgcatatgtcgcatcctctaagtcggttggcttgtagaatttaccatcttgacctttaaccactttttcatcgcccagataataatcaaatggtctatttgaattggctgatgagagtttttgatcaagttttttaacttccgtatccacatagtttttattggcgacacttgaaccgtcagccttatcatctaaatcagcaagaccggtaatcgcacctatatatttaccatcagcacctttaccaaaagccagcgtcgctatatctttctctttacctttaccgtctttatctttggtaactttcaggctgatggcatcagttgagctatctttgcccttcacggtaaagccgtctttaccataaacagcatgggttttgtcgccattagttgcgtctttatcacccacggttaaacctttatcgttcaaggtcgcaatggttgttttaccgtctttatctttcaaggcgatttcatcacckttgatatttaccgtgttacctttgtcgttcttaaactcggcagacttcaagccttttaactcctcattgagtgaaatttctagcttgctcttagcactatccgccttcaccgcaatattgccatcggtgcctttgaaatcagcgactttagctttatctaagccttgacctacaatttccagtttttcgccgaggtttttatgcacaatgctgtcgctgtcattaccggcaaaatccaatcccgcttgtgcgacagcttttaagtcggcaacattcacggctttatgcgatgaatctttatcaagctcgcctgacacgagttttttcaccaactcacgttgtttaccttgtgcagctgaagcaatgccactgtctttaatatcatcaatacccaaaccggatttaaggttatcaatcgcaacaggtgcaactgttttgcctggttcaggtttaccgcctagagtgatggatgtttttgtgtcatcatcatatttcacagccactttctccgcttcggagtgttgtgcggtgactttccctacaatagccttggcaaccgcagacaagtcttgaacattgacagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccagcccactcgcaagtcctttaatttgtttggtatttaacgtcaagccggttctgtcaaagacaaaggttccaccattggattcaatgacaacattagtttttggttttgtaccattcgctccttgtttgttaaattcaatgctagaagcgatttttttacctttgccagctccgatttctcgacctccaatagacttaatgcctttcaaatcagaattgagagcaatttctagcgtagaggaatctttcttcgctgtggtagtgatattttgatgtgttttagccgaacctgaacccaccttacctttaattttcaagctgtcattaacggtaaatttagagcctttattcccctcaacttcaaattttgttgcatagttcattaatttctctgccaccgctttggaggtaactgctctttcatcgtgttcggaaacattatccgctttattyaragttaarrttaayttagcmtygtctccttctttttcgactttcgttttaatatccttttctttcatgcctctatcatctttcttggcttccgaactgtcgatcgtcaacaacttgtctaagttgaccagttgttctgtttgacctgcgtcatttcctttgaatttaagccctctttcgtccacatattttttattggcggcgtcatagttgtccgtcggatcggcaacaaacacaattttccgcttatgtcgcattgacccgactgacaatgcattggacttcgccagcgaacctgtccccaatacaatggcattatgtatctcatcatctgccgtgatattcgagcctaagatgatgttttcgtttccttcaacttcatttcttgaaccgattgaaatattctgtttaccggtgattttgttgtccgatcccattacgtaattttgttctttctcaataacgttattatcccccacggcaaatgagaagttgcctcgtaccgtgttttctctaccgataccgatcgaactcattccaagcacattggaatcttgacctattgatactgcacctgtattcaatgcgtttgctccgtaccccatggcaatagatccttcatttctcgatatcgcaccatgtcctacagataccgaaccatcccccaacgcttccgttgttggtgaatccgacactttcacggatttatcccctgtaccttttagataatctattaatgcttgtgcttgaactaattccgttgtgctttttttaccattttcaaggtttattttgccaataccgacattttttccaaagtcagcttgtttatcatcaatattcgagccatctacttttaaatacgccgtgcctaacttatcaactaagtcagtagtcttggtataatttttcaacgcgtccgcgactgcttttgaggtaacgacttttccgttgttttcctccactttatcagctttatttaatttcagcgtaagtgtacccgcactttgaggatcgctaccattagatggtgccaatgttaccgtgatgtctttttcaacagtcgcactatttgctccagtcgtatcgctactgctaacaggcgagctatcaatcgtcaatgttccgcctaattgtaatgtggtttgtgtcgacttgtcatcattgcctttaaaggtaacacctttattgaccgctgtaattaacccatcaatcgcatctttataggtcgtgtatttatcttttgaaacggtagaagttgtatctgtatctgtatcatctcccttaactttagtaaatgatggtgcggtaaagttaccagttttatcaacagaaagccctaatttaccgactaaatcgtgaagttgtttaccattaatcgcatcagttgaattctctgcaatctgtccaccggcgacatttgagattttaacgtttttatccttgtcagtttttccattcactggggtaaaagttaacgcatgtccatccacttttaactctgctgtgttcgtgctacttgatccatctgtgttactcgtattatttttaaacactaaagcgttgctgtcatctttaccaatcgactcaataccttttaagtccttattaagtgcaattgttaactcacttccactagcttttgtagtgatattttgatgttttttgttatctgtagctgtagcatttttagtttccgccccttttatagataaagtcccactgatattatcagtattaccctcatctgaagttaccataaatgcagaggctttgtttgctagcaaattatccacatattttttgttgacggcgtcataatcttgctctggatcgcctacaaatactattcttcttctatttctaggtgttccgactgataacgcattagataccgctacagattgatttcctaatactattgcattttcagtatcttcaccaacatttatacgtgagcctaataatatatttccagttccagagacttcattattagatcctaataatatattttcatctttttctattttattactagaaccaatagagatatttctttcaccacttatattattatttgatcccattacataagttgatgttgattttgaacctatctcattttcatctcctactacaaatgagaaattaccatttactttattatctttacctaaaccaattgaatttactcctaatacatttgagccttgtcctattgatatagaccctgaatttaatgcattggctccatatcctaaagctattgagccttcattttgtgattttgcatcgtatcctatagagatagagccttctccctctgcaattgtttttgaagaatcagagacttttacagatttatctccactgccttttagataatctattagtgcttgagcctgtactaattctgttttttcttcatcatcaagttttatttcactaattcccacattagatccaaattctttttgtttatcgccaatattttctccagtgattcttaaaaagtcttcttctaatgtttctgtagtagcgaaatcttttaatttatctgccaccgcttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctataccacttgcaatatttttaatttgcttattacctaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctttttaaatgtaggattttcttttatgccgattaaaagctcttttttatctttttcatactgagttctgatattattacttgaatattgagtttctgtttttagtgccttatcttcaacctttgtattcccagccttaatgattaatttatcgcctagataatgcgttctttgttcaccaccatctccactgccaaaaacaaagccactattaannnnnnnnnnnnnnnnnnnnnnnnnnnnnnnnnnnnnnnnnnnnnnnnnnnnnnnnnnnnnnnnnnnnnnnntatatttagctacttcaaattccgattttttaaatcccgttttactagcgtcttcaacttccgcacccaatacattcaccgctaattttgaaaactcatcggcgacggcgtagagttggcttccgttgatagcgtcggtcgacgttgccgttaccgcacctgcggcgacgtgtttaatgatacgctcattatttgccttacctatgcttaaaacggattttttatnnnnnnnnnnnnnnnnnnnnnnnnnnnnnnnnnnnnnnnnnnnnnnnnnnnnnnnnnnnnnnnnnnnnnnnnnnnnnngtgcggtttcttttttagtcgcttntgasccttgccccaacgcaatagaatcccctgctgctgtttcaaccaccgcactttcgcctatggcgacaccgccctyggctttagattgggcttgataaccaataatmactgcgttttttgcaccattttcagcttttgtywywgcyccgataagyacgctgtttkytgcattttgggcattggcttkattaccaatcgcaactacatttgaattagcgaatttgtcagaaccattgccctcaaatccwatattaatattattccccaacgccacgatatctgtgccgctgttgattttggttttattaccgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatttgaacccaatacaaatgagttaggaatatcaacactgacatttgtccctatgacgatagcgttttgagcttttgagcttgcacctttaccaatcgctataccagcagtagctgttgcactcgcatctacacctatggctacagaattgcttcctttggcaccatcattgttataatttgaaccttgttgcataggattattcacagacaaataatgcaaagttcctacattttttacgcctttcatcgcttcttttaattgagcaaggataacaacgtcggtatctttcgtacccggtgcgacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatcttagcattttgtcctataacaatagagttgtcagaatttgctaaagcacctacaccaattgccatcgaacctgatttttttgctctatcgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttctcgctttaagttttaaatattctcttttaattttaatatagtttttataatcctgttcttttgtgactaataactttaagtcatctaagcctttgacagagacatatttcacgccggaattaatattatcttcttctaacgtattgccatacaggatagcttcttctaaggctcttaattgagatacgttgaccgcatcagtatcgctcgcacccggtgaaacgtttacgatacgtctttccgcattcttgccccccactgacaaatagccgattctttctgatgaaggtattgatatggcatttttaggtgcccatccgccttgtgccatttcagtttgagtataatcagtttttgcattgacgcccaatgcgatggaatctgaaaaagaggcttccgcaccattaccaattgccattgcatttttaatggtaaaatctgattttccattttgcttatttttttcacttcgaagtgcggttggcatttcagctaaaacttttgcttttatacctaatgccatagaatcatcagcttctactaatgaatgagtaccaaaagcaactgattgtttacctaatgctcttgtgaaatttcctattgaaaatgaagattctttttgtgcaaacgcaaatctaccgagtgcaacagtactatcttctttcgcataggcatatctacctaatgagattgcattatcccccaatgcaacagaataagaacctatggcaatagcaccttgattatgtcttccctrcctatctttagattgctctgctttttcttcgcccgttccttcttggacggttgtgtgggcattaatatgttctttcattatatcttgtatcgctgctgtatcaccgatacgatataaatcttcgatggttattttgttattttgtaatccttgtggaccgccatcagcgtattcagggtaattttgtttatcttttgctaataagttatatggttcaataccaagcccctcaccattaaataccttacccatcttcacattggcaaaggtgtgatcaccaatcgctaacgatcctaagccccctgcaaaagagtctttaccatataccatagatccggtaccgatggcttgtactttattcccgataccaacagatccgtctgcatagacatagctgttattacccatcaccaatgaaccttcaccaaaggcgacggtgtttgagccgatagcggttgaataatctttagccgctacagcaaatgtccctaaagcggttgaattatctccataggcaattgaacgtgccccaatagcaatggcgttatttcctcttgcccaagtatgtgttttggtatttctatgatctgctaaatatttttgataagcctctccttctttttttagatagagttcatatcttttatagtctgataatgcctttatttgttttattttttcttcatatcctggggtgttaggatcgatataatttttatatgcggcgttttctgattcaacatcataaaaattttccccctctatgcggtaatatccacctttatagtctttaccattttttctcacaaaatatgtgccgttttgatatattggtgtgtaaccatcttcagctaataactgtccttgatcattaagcataggcttaccgctatcatctttcataatctcaaaatcaacggcagcatattctttggtatagttaaaatcatttcttacattataaaaaagtctaaacatctctttagaaagcggtttggcatcatgccctgcggcattatcgctcccgatagaaatagaggaatctccccatgccaccacatcgttacccaaagcggtcgcttcttggcctcgtgcaaaagatcgataaccgacagccgtaccttctttatttaaagctcttttaggatcttttttgcgtttctctttctccattattatcacttggttaataatgtctcgttttttttcttctgttgtaggtttccacttaggattagtggcaaattcaaaatacttttctcgtaagtctttatacgaaccatcttcgtctttgagcagaatagattttgcttcttcttgcgtaacggttggattgtgagctgaagtcgctgtattttctccggtagcggctccaaaaccgatagcggttcctttatcaccgcccacgactgctcgagaccctatcacaacagtttgattaaagtctttattgctatacgaagcattttttcctgttttattagcataatccgagaggataaccgcttcatcgggaatatcagattgtttatatggtcgattccaagatccatacataatttgcgttttacggtttagggtgcttatcgtttgtccatctgcaacatcagcactatgaacccaaacatcatacccatacgccgctctcgataacagcccactcatcancaacgccaacggcagaaccttaaacgcccctaacataccgccgaaaaacacaccgcacttcggctgacttcccgccgcctcaacacggctcgccacctgacggttattcgctaattcagacactactttagtttgaccggttgttacatcgtattttgttttgaagattttgttcataaattcactctctttaagcttttaaaattaggttttttaataatgtatgttgtcgattttttaacttttacggttgtttattgattaaacgtgttactttttagatagattgataaataaatcggcgatgccttgctttttaagacacagcagaaaaaggcgaataatactttcgccgaaaggttgaggttgaaataggtgatttttatttttaagacgttgtttgaacatgtccaacctctcaaaattaacttgaaaggttgattttagccaatatactaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtaggctgtcattttttctgttctattttatttgtcaagtaataattcggattattctatctcaaaattgttatgggaaaaacgattttttatttttttattcacttttttgtttgttatcagctaaaagatatttttttgcggcggctaaatattgaaacattgaccaaactgtcaacatggcggcgatatacaaaaagacaatcgctgtaatttccattaatgtattgtagtgccataaaagaccgccaagtgcaagcatttgtgaggctgttttaattttccccagccaagaaaccgcaacgatgccacggctaccgatttctgccatccattctcgtaatgctgaaatcacaatttcacgaaagatcataataattgcaggtatcgttacccaaaaaacatgttgatattcaacaacgagcgtaagtgccgcaatgaccatgactttatcggcgacaggatctaaaaacgcaccaaaaggcgtactttgattccatcggcgagcaaggtaaccgtccagccagtctgttattgaggcaatgaaaaaaataatagttgtgagaaaaggtgcccaatgaaaaggcaaataaaatgttacgataaagaacgggattaatccgactcgaaataaagttaagattgtaggaatattgaatttcataatgctgttttgagtagagtagggatacgctgtattctaaagtatatcccttatttttaaaagcctgatgaaactaacaaagtgaaataattagttgtttttgatatgggattttaacgtttgttcaatttcataaatccaatcgagttcatattgagtaaaaccggcttggatacgagcatcagtattaataactcctttaaaaatcacgatgcgatatttacgtaataattcgctaaaacatttcattgcatctaattgacgtttagcggaaagtgcgtgataccaatgattcccaatagaaacatgaccaatttcgtcacgcaaaataatatctaaaattgccactgcctcgacgtctttacgctgtgcaattttttcttgtagtattgggtttgcatctaatcctctggcttccaaaactctaggtaccaatgccatacgctcccaaatgtcatgagccgtcgcttgagccatttcccataagccggcatgtgcttcaaaatcaccgtattgatatcctaatgtgtttaaatgctcattcacgagagtaaagtgagtgctttcttcacgtgcaactttgagccaatcttgtatgaacggcatgccttgttcgagttcctcttgtgcgtgacgtccaaatctccacgcagcatctaaaccaaggtttattgcattaaattcaatatgagcaatggcatgtaatgttgccgcataaccttcgtttgtggcaaaagaacgtttcggcacattttggggagcgacaaggaagggtttgtgtggaataccgacaatttcttgttcaggtgtaacaagaggaaaatcgtccgtttgatctagatttatcgtaggcaaaatttcatcatataactgattcactaaacgacatttttcatagggatttgtttctgccagtgcggttgttattttatgccaaaagtcttgagttgaaagtgcggtcatatttttccttatttcatagaataatttttaatcgctcaaagtatagttatcagagaaagatttgcaatcggaatttgcttataggataatgcaccccattagccgttcggttaattctatggaaatcttttcggttcctcgcaatagtgtccgatttactcggtcaggttcggaagaaagcagccaaagtcggaatttctgtgtgccgagatcctgccggaaaggtttccgcccatctactacatttcaatatgtataaaaaaagcaacttttcagttgcctttattcaatttagctttgttcttttactgcctctaatgcacgcaaggcataagtataggccgcaccggcgttcagtgcaatcgcagtagccaatgctccggcaatttcactttctgttgcccctgctttagctgctttttcagcatgaacactaatacaactttcacaacgtgtcgtaatagcgacagcaattgcgataagttcacgagttttttcatcaagtgcttcagccgcagcagcctgatctaagttaatataggcttgtaacattttcggatgagacttgcccaattcgccaaaagattttttaacatgagcggtatgctctttccaatctgtaaatgttgtcataagaatttcctcttgttgttaatcaagttaatgttgataattaaccgcacttttataacttgattgactaaaagtgcggtgtaatttgaacatattttttagatttaaattcgttcaataagttgtttaaaaaatcctttttcttgttgaatcagttgatggtaatgtccttgttcaactagatggctgttatccatgatacaaagtaaatcgaattgttcaagtgctgttagacgatgagtaaccataatgaacgttttattttgacaatgttcaaataatagcgttagaacatggcgttcagtatctcgatccagtccttctgtcggttcatcaagtagaataatgggggcattattcagtaaaactcttgccagtcctaagcgacgctgttcaccgcctgataaaggtcgcccgccgtcgcctaaccataaatccagtccttgatcctgctgaactaatttttccagacctaccttttgtagtatatgacacattttttcatcgctgatttgttggctacctgctatttgtaaattattgcgtaaagtatcactaaaaatatgtactcgttgagtgagtaaacagatattttggcgtagcgtttcttcggtataaacttgaatcggtgcattagagagtaaaatttccccttggttgcaatcatagtttcgaaccaataattgcagtaaacttgatttgccactccccgttttcccgagaacagccactttttttccagcttcaacggttaaattaatttgttgcaatgcctgatcattgcgatccggataagaaaaactgacatttttcagttgaataagcggatattcattgttttgcaatatgtgagtaccgttgaattgcactaaaggtcgttgtgcaagaagttcattaatgcgttctgcagatgaaatgacttgtccaatatgtaagaatgcggcactaataggcatgagaagctcaaatgaggcaagagcggcaaacgcaaataacgcaataaaagcattgtgataatctgcaatggaaaattgtgctttcgccgcaaaccaaagggttattacaaccagtaatccgttaataaatacgacaagtgcggtagataatccgactaaatttgtttcttgttgttggtaagattgccattctaattcgattgcttttagtttctcttttgagccaaaggctgcattaaagagtaatagttccgcttgcgactgaataaattcgataaaataagtgcgataaactgaacgagattgagttaatttagcaccgaatttacgtcccagccgataaaaaatgatgggaataattaaaagtagcaacagcaggcttataccaataaatacgccgatagaaacattaaataaacttaagcctaacgtaataaaagcaataacaatcattgcactgataaaaggggcaataaggcgtaaatacaatgtatctaaagtatctacatcagccactaaacgattaagtaaatcactgttgcgatagcgattaagtactgcggggcttaaaggaataagtttactgaatacttgaacacgtaattttgccaatacacggaaagtggcatcatgcgtcactattttttcaaaataacgtgttacagttcgaccgattgctaaacctctgacacttgccgacgggtagaaaaaattaaataatgtgccaataccggctaacgccgtggcggcgagaaaccagccagatagggttaataaaccgatgcttgaggctaatcccgcaatcattaatattccccctaaaatgagagtaaatttagcgtgataaaataagcgaagaaaaggaagtaaagctcgcattattgaatttcctgtttttgttgagccaaaagttcggcgaagaaaccttgttcttttaattgttcaaaacggccttgttgcacaatttgcccttgttgcatcactaaaatttggtcgcattgttttagatcttcaatgcgatgcgtaatcattaaagtagtttggttacggctaattttttgtaacacttgtagtacggcattttccgattttgcatcaagacttgcagtaggttcatcaagtaataataaattgctttgacgcaataatgagcgagcaataacaagacgttgtgcttgtccgacggataaaccaataccgccttctctaatcagaaaatcaagtcctaatttcgcacaaaaagacgaggcttgtgcttgttctaatgcttgcgtaatttgttcgtctgttgcttgaatatcaccaaaaagtaaattttctcgaatcgtgccttgtaataataaaggattttgccctacccaagcgatattttttcgccattcgtttaaagataaatcatgcaattcaataccattaatttttaaacttccctgataatttaagaaaccgagtaacacgttgattaatgttgttttacctgcaccgctttgcccaactaacgcagtattgctttgagcagtcaagcaaaaatttaacggagcggttaaaggatggccttgtggtgaaagtgcgatgagatttttcgctataatttcgaccgcacttttaggctcgatactatgtgtttgttcatattgttgagaagtaacttcttgctccaaaaatttaacgatttcatcagctgcaccaatacctgctgcacgatcatggtaataagcacccagatctcgtaaaggttggtaaaactcaggagcaagaattaagcagaaaaagccaataaataaagtaagttcagtgtcgtaagaaccgaagttaatttgtcctaaataactaaaaccaaaataaactgccattaatgcaatagagatagaagtaaaaaattctaatactgcggaagataaaaatgccatttttagcacagtcatagttgtttcacgaaaatcttcagtgctttcttcaatatattcagtttgctcttttgttttattaaaaaggcgtaatgtttctaatccacgtaaacgatctaaaaattgaccgctaagttttgctaaggcggacatatttttttgactactatctgcggcggctaatccggctaaaatcataaaaataggaataagcggagcagtaagtgccaagattaatcctgccgcccaattgagtggaaagacagcgattaagataatgattggtgtaatggctgaaagtgcttgttgaggtagaaagcgagcataaaaattgtgcagattttctacttgttccagcatcaaggttgcccaacttcccgcagatttttggttgatcattgccgggccagcttgatgaattttggcgaaaatttgttgacgaatatgatgacgtaattgttgaccgcatttaaagcccactttttcccttgcccataatattaaaccacgtagcataaaaccaagaataagtgctagaaagtgcggtattaattcacttcgatccgtatttaaaataatgagttgatgaagcaggtagcttaaaatataagtttgtgcaactaaaacaacggatgaaatagttgcaagaataatattaagcgaaagcaactttttgattggcttttgttgtttgcgtagccatttgaaaacatacttttgacgtgatttttccattgttactgctagaggttatgatatatttgtggggcaaattagttgccccaatatgactgagttaattatttttgtgtatccaaaaaacgttctgcatctaaagctgccatacatccagttccggcagatgtaattgcctgacgatagttgtgatccattacatctccggctgcaaaaactccttggacagatgttgccgttgcattaccgtccaaaccggattttacgacaatataaccgttgtttaattcaagttgattggtaaacaattcagtgttaggagcatgaccgatcgcaataaataccccttctaatttaagatcttcaacattttctgtttgtgtgtgttttaaacggattccggttacgcccatattatcacctaaaacctccgctaaagtgcggttcgtatgcaggataatttttccttcttccacttttttattgaggcgatcgattaagattttttctgcacgaaaagtctcacggcgatgaattaaatgaacctcagaggcaatatttgcaagatataaggcttcttcaacagccgtattaccgccaccaaccacagccacaggtttattgcgataaaagaagccgtcgcaagttgcacaagcggaaacacctcgtcctttgtaagtttcttctgaaggtaagcctaaataacgagccgatgcacctgttgcgataatgagtgcatcgcaactgtaagcccctgcatcaccaaatagtttgaatggacgttcagataaatcgacattattaatatgatcgaagacgatttcggtatcaaatttttcagcatgttgcaacattcgttgcattaattccggacctgttgtatcaccaaagtctcccggccagttttctatttcagtcgtcgtggttaattgtccaccttgttgtaatccggtaaccaatacgggttttaagtttgctcttgccgcataaattgcggcagtatagccggcaggaccggatcctaaaatgagtagttggctatgtttaaaatctgacataaaaatccttgttagtaaaatcttgcaagattgtgggttcgcttattatagagatttcaataattaaatctatcattaaatagaaaaccatagtggctattatgttgctagaggcactatttttaacattaatatttgactgtgtgtccataattttcaatgatagatttgatatgttccagtgaatctttagttggagggactacatcttccagttcatattgttcgcccatcgttttccatttatgtgcacctagctgatgatagggtagaagttcgacctgttcgatattgctcatattttgaataaattgacctaataagtgtatatcttcatcagcatcagtataaccgggaacaactacatagcgaatccaagttttttgattgcgtttttgtaagtatttggcaaattctagtgtacgcttgttcggtacaccgataagattttggtgcactttatcattgagctgttttaaatcaagtaaaacaagatcggtaacatctaataattcatcaatgacatgatcataatgacgtacaaagccatttgtatccaagcaagtacttattccttctgctttacaggctttaaaccaatctcgaacaaattcagcttgtaagatagcttctccaccggatgcagttacgccaccgcccgttgcattcataaaatgacgatacgtgaccacttctttcattaaatcttctacactgatttctttgccatcatgtagatcccatgtatctcgattatggcaatatttacaacgcattaagcagccttgcaagaataaaatgaaacgaatacccggtccatcaacagttccacaagattcataagaatgataacgtgcgagtacagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggatatgaattttgtagaaggcttttctgggcaagaagcgatttataaccaagaatctgctgcagcattatttaaagagcagagtgaggcgacccatttacctttcatttttttaagtgccggtgtatcaccgcaactattccaagatacattatgttttgccaagcaagcaggctccgattttaacggcgtactttgcggtcggtcaacttgggcaggtagtgcggaatcatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaaaaacggcggtaattatatcatgcactattaatttgtaacttattctttggattgttcgggaataatgacatccaattcgatccatttgtaccaaatttgttgtaaaaattttagtattttctcatcaattgcaagagtttttaaagactcttttagttcttgtagtgagtaagctttttcttgtaacagcattaataaaaaatgatctaagtccgttaacttttggtaatacacctcaaattgagcattacgccaaacaattgtttttgatggttgattcagtatttggttaaactgagttgaaagaaaatccaccggatattcttttataaagcaaacctctgagcatttcattggggtttgttcagttatatcgaatttagtcggtagctgaaacattgatacttccgcttgaagttgatcaaattcaaattgcattagggagagaatattttcatcgaaaatatttttgtgttggcaaaattgtaaaaactcacctgcaatatcttggaagtaaggggaatgtgcttttccgtttttgataaattcttcttttgcattatcccaatcttgtcggtttaaatgagccggagtttcggtaaagcatttttcgataaagccaaaagtattgttgcgtaataaccgcacataaatatttaaacgtctaggatcgtgattgctagggtctttttcacgaatagcttgaacaaattcttgttgcgtttgtgctagatttttaaccatgacaatcctctttttttgacatatttttgttgtagttgatggataatatcgacttctttacaaagtttttcaaaaggggggaaattgaaatcacgttcaagtagtgttggtggcatatgaggtaaacgtgcataagtatattccagtaaatcccaaacggtaccttttacattttcaccatgtgtatcaacaagtaattgaggaagatggcgaaaatctcctttgattgtattgaaagcctctgatgtttgtatttggagtttagtagcagaatgctcttcatcatgcccagcaatatgaatataattgacacgttttagatccacattatcaatgaatatatgaggatcaagtaagttatgattgaccgcatttacatagatattattgacatctaaatgaatgccacaatttgcctcttgtgcaatagcattgagaaattctacttcattcatcgtgcttgtttcagaatgcaaataataagaggtgttttctactgaaatttgaatttctaaaaaatcttgtacttcacgaattcttactgcagtgtgttttactgcttcatcagtaaacggcattggcaataaatcatataaatgaccatcgcattcgcaaaagctcagatgatcggaaaagaaaggcgtattatattgttttatcatggctttaatgcctgataacaattctttatctaaaggggcttgtccaccaagagaaagagataacccatggattagcatagggattttttctgccactttatcgaattgataacgcgcaaatcctcccatttttaaccagttttccggtgctatttccataaattgaattcgatcattattgcgtaactgtagaaatccttccgctagatcacgtctgtagcctaaaccggcaccttgtcgcatatatcctccgtgtaaataaaaagggtgcgatgcaccctcaaaaatttatttagatgcaccgcactttccttcgccacatttgccttcggcagatttcggcatatttttcttaggagcggttgcaccgcattttccttcaccgcatttgccttcggcagattttgatacacatttgccatcgtgcatttcacactcggttgtgttttttttcatatctgcatgtgctgatacagccatagctaaggcaccggctaaagcgactaaagttgtttttttcatggtttttctcctatataaatgattaaagtaaattcagccgtttttgagctgagtattttttccgtaacagaaaatcaagtgaaactacacccgcaccttgtaggagcagaggaagtaacgtaattatgtaaatgagcggtaatttataaccattgttgcatacgttataacctaatccgctatgtactgttgcccaagctacagcggttaaaatcatcaaccctaaagcactaaagcgagttgcaatacctaaaaccaacaaaatcggaaacaataattctgcaccggttgcaatagcccaatttaagtccagtggtaaaattgagaaaggaaacggaaaattgtcttttaccgcataaaaccaattttcaccgttccatttttctagtcctgcttcgaaaaactcataggcgacaaaaaaacgtaatacgagtaaggataatccctgagtggattgtttaaaaatatgacaatgagacattttctactcctaaaaaattgctttctagaagttagacgaatgagaaaataaaaccttacaaaaaaatttcaaaaatttagaaaaataaaaaggtcagattttactctgaccttttaaatattctgatttaaaacttacattgacgttgtgaatgtacgtgtaattacatcttgttgttgctctttagttaaagagttgaaacgtactgcgtaacctgatacacgaatggttaattgcgggtatttgtctggattttctaccgcatctaataacatttctcgatttagtacattcacgtttaagtgttgaccgccttcaatagttgtttcatgatggaaatatccatccattaaacctgccaaattgcgtttttgtgcatcaatatctttacctaatgcattaggtacgatagagaacgtataagaaataccgtctttagcataagcaaatggaagtttagcaacagaagttaatgatgctaccgcacctttttgatcacgtccgtgcattgggtttgctcccggtccaaatggtgcacctgaacgacgaccatcaggtgtgttacctgttttcttgccatataccacatttgaagtaatcgttaaaacagattgagttggtgttgcattgcggtaagttttgagtttttgaattttcttcatgaaacgttcaaccaagtcaaccgcaatatcatctactcgtgaatcgttgttaccaaattgtggatattcaccttcaatttcaaagtcaatcgcaacattttttgaaataccgatcacgtcgccagctttatttttcacttcaatatcaccacgaatcggttttactttagcgtatttaattgcagaaagtgagtcggcggcaacagaaagaccggcaataccgcaagccattgttctgaatacatcacgatcatgcaatgccattaatgccgcttcataagcatacttatcgtgcataaaatgaatgatgtttaatgcagtaacgtattgttttgctaaccagtccatgaagctgtctaagcgagtcatgacatcttcataatctaaatattcagttgtaataggatcggttttagggcccacttggtcaccggatttttcatcaataccgccgttgattgcatacagtaatgtttttgctaagttcgcacgagccccgaagaattgcatcattttacccacgatcattgggcttacgcagcaggcgattgcatagtcatcattttggaaatccggacgcattaggtcgtcattttcgtactgtacagatgaagtatcaattgatactttcgcagcatagcgtttgaaaccatcaggtaaactttcagaccaaagaatagttaagttcggttctggtgaaggtcccattgtgtaaagtgtatgcaagatacggaaacttgttttggtgactaaagtacgaccatctaaccccataccggctaaagtttcagttgcccacattggatcaccggagaataattgatcgtattcaggcgtgcgtaagaagcgaaccatacgaagtttcatgaccaagtggtcaattaattcttgagcttcttgttctgtaattttgcctgctttgagatcacgttcaatgaaaatatctaagaatgtggatacacgaccaaaagacattgccgcaccgttttgtgatttaacggcagcaaggtaagcgaagtaagtccattgaaccgcctcttgagcattttttgctggagcggaaatatcatagccgtaagatgctgccatttctttcattttgcctaaagcacggtgctgttcagcgatttcctcacgtaattgaatcgttgcttgaatatcttcaccgctctctaatttctcttgtaatgaagtaaattgtttgaatttatctttcattaagaaatctgcaccataaagtgccatacggcgatagtcaccgatgatacgaccacgaccgtaagcatcaggtaaacctgtgattacacctgatttacgacaacgtaaaatatctggtgtataaacatcgaatacgccttgattgtgagttttgcgatattcagtaaagattttttcaacttctggattgagttcacgacggtaaactttacatgagcctctaaccatgttgattccaccaaacggcataattgcacgttttaagggagcgtctgtttgtaaaccgacaattttttctaaatctttattgatatagcccgctttatgagaagtaatagtggatggaatatctgtgtcaatatcataaggttcgtgagttttgttctccactttgattttttccattacatcagcccacaggattgatgttgcttctgttgcttccgctaagaatgcttcatccccctcatacggagtatagtttttttggataaaatcacgaacattgacttcagtttgccaatctccaccgacaaaaccttcccaagctttttgttgagtttctgttaattgagccatcgctaataacttccttttgagtaaataaaaataaaactgttgaactttgtaaaaacaatcgaaaaacagaccgctcttacaccctaatgatttattagtgtctatgaggtttattggtaaaccattgcattaatgcaatacaaacaccgccaccgataatattccctaaggtgacaggaattaaattcttaaagataaaatggtaaatatccaaatcggcaaattgcagaggattaagattaattgcttgccaaaaatctgttgagctggcatgtgaggtaattattcccattgggatcataaacatatttgcaacactatgctcaaagcctgaggcaacaaatagacctataggcaaaatcatgatgaatgctttatctgttaatgtttttccggcataactcatccaaacagcaatacataccataatgttacatagaatacctaagcaaaatgcttcaagccatgtgtggtgaattttatgttgtgctgtttttagaatggttaaaccccattgtccatttgctgccatagtttgaccggcaaaccaaattagcaatacgataattaatgaaccgacgaaattacccaaataaacaacaagccaattttttagcatttgagttgtggtaattcgtttattcacacgtgcaataagagacatagttgatgatgtgaaaagctctgaaccgcatactaccgccataataataccaagagagaaaaccaaacctccaacaagtttggtaagtccccaaggggcattacccgaacctgtctgagtagtagtgtaaaaaacgaaagcaagggcaataaatgcacccgcagaaattgcagataagaatgagtagaattgatttttagttgctttataaacacctacattctcacctatttgtgccatttcgctaggtgatactattatggttgtattttcggttttcattacaaaccctattgaaattaaactggcgttattctaagtcattaaccggaaactttaaactaaaaaattttttattttttataaaatttgttaaatgaaattatttttaacaagtttttaacatttagttgttttacatttattaaatgcaacaatttattaacattagcaatctaaattgctatttaaagggatttctgatacaaaatgcacctattatttttatatcatgggagaacaaaaatggtagaagaaactatttttagcaaaattattcgtaaagaaattccggcaaatattgtttatcaggatgaattggttactgcatttcgtgatatatccccacaagcacctacccatattttaattattccaaataaaattattccgacagttaatgatgtaacatcagaagatgaagtaacgttgggacgtttatttaccgtagcggcgaaacttgctgaaaaagagggaatagcacaagacggttatcgtttaatcgtcaactgtaataagcatggaggacaagaggtttatcacttgcatatgcacttggttggcggtgagcatttaggcaaaatgttggcaaaataatgaaaaatttacttatcgcttttattttgagtttgggattaattgcttgtggttctttggaaaaagtaaatttagtgcattctcaacaaccaattataaatattagtaccgagcttgcttctgatattgacgtacaagtcagccattcatcagcatcgctgacaaacgtttcacaaaagcaagtgacgctcgtatattattttttttggtacgataaaaatggtgtaacacaaggtgatgtgactaatatgaaaaatgccactatgctgattttatcgccaggtcaaacacgtcagttagtattacaaaagccgacaacagaaagtgtgaattaccgcctttacttgagtttatagaacaaaatgtcgatattattaatagatttatcgggtcaagagttacgtcaagaagaaatcgaattacttgaacatcctctagtcgcaggattaattttatttagccgcaatttttatgatattgagcaaatccgacatctcattagatctgtgcgtcaaaaggttaaaaagcctttattaattactgttgatcaagagggtgggcgagtacagcgttttcgtcagggtcttacgcaattaccggcaatgcagtcctttgcctgtttactttctgaccctcaagagcaacaggaaatggcttggcgagcaggttggcaaatggcggcggaaatgaccgcacttgatatcgatcttagctttgcacctgttttggatcttgggcatcaatgtaaggcaatcggcgaccgcagttttcattatgaggaaaagaaactgattgaacttgctgagaaatttattcaagggatgagacaaatcggaatgtcggcaacgggtaagcattttcccggtcatggacatgtgttagccgattctcatttggaaacaccttatgatgatcgagcaaaagaattaatttttgcacaagatattcgaccgtttcagtctttgattaaacaagggttgttagatgcagtgatgccggcacatgttatctacactcaatgtgataatcaaccagcaagtggatcgtcttattggctaaaggaggttttacgtcaacaattgggattccaaggagcgattttttctgatgatttgggtatgaaaggtgccggttttatgggggattttgttgctcgttgtacgcaatctcttcaggcgggttgtgatttattgttgttatgtaacgagcctgaagcagtggtgcaagttttagatcgttttaaaccacaggaaagtcaaaataaacgaataatacgccaaactagattgaataaattattcaaaaaacaacggattgattggcaaaccttacgcactcaacgtgattggttggaaaatcacaaaaaacttaccgcacttcagcaagattggttagcctataaggggtaggacaattagaaattatggaggtggttttttgagagtatacaaaaataaagaagaactcaaaactgaaataaataaagcatttaagaagtatattttagaatttgataatattccagaaaccttaaaagataagagagttgataaagttgatagaactccagctgaaaatcttgcttatcaagtgggatggacaagtttggttcttaaatgggaaaaagatgaaagaaaggggcttcaagtaaaaacaccatcggatgaatttaagtggaatcaacttggtcaattatatcagtggttcacggatacttatgctcatttatccttgcaagagttaaaagcaaaattaaatgaaaatattaatgctatatgtacaatgattgattcgttgagcgaggaagaattatttgaaccgcatatgagaaagtgggctgatgaagcgactaaaacagcgacttgggaagtgtataagtttattcatgtcaatacggttgcaccttttgggacttttagaacaaaagtcagaaaatggaagaagacagcattataaattacctttttacaaaaaaatttcataaaaatagttaccaaaggcaatagagaaaactatcgtctttctctttgcaaatttaaattttattaaattaatatgaatttaattcatgaaaagtataatttttctgaaattgacacatattttctttctctttatgatgattttaaccgatttaaagataaatttattatggagtaaatgaatatgagttataccaaagaattagatacattaaatcaccatatggttgatattaatgggaaaattaatgtttcttttgagttttttccacctaaaaatgaaaaaatggaaactcttttgtgggactctattcatcgtttaaaagtccttaagccgaaatttgtatcagtaacctatggagcaaattccggtgagcgggatcgtactcataccgttgttaagcgtattaaacaagaaaccggtctggaagcagcaccgcatttaaccggtattgatgccactccggaagaattaaaggctattgctaaggattattgggatgggggtattcgtcgaattgttgctttacggggtgacgaacctaaaggttatattaagaaacctttttatgcctccgatttagttgagttattacgttcggtagctgactttgatatttcagtggcggcttatcctgaagtgcatcccgaagcaaaatccgctcaagcggatttaattaatttaaagcgaaaaatagatgcaggagcaaatcatgtaatcactcaattcttttttgatgttgatagttacttacgttttcgtgatcgttgtgcctcaatagggattgatgcggaaattgtaccgggcattttaccggtaacgaattttaaacaattacaaaaaatggctgcgattacaaatgtcaaaattcctagttggatggcgaaaatgtatgaagggttagatgatgatcaaactacaagaaatttagttgcggcaagtattgcgatggatatggtgaaggttttatcttgtgagggggtaaaagatttccatttctatacactcaatcgcagtgagttaagttatgctatttgccatactttaggcgttcgcccaagtttataaaaaaccgcactttgagcctaaaaaaggactaaattgttaaaatttggtccttttatttttacggattttattaagaaatgcacaatttaaaatggaatgtcatcatcaagtggagcatcaacaggtgatggagatgcaatgctcggtttaggtcgagaatgtgattggtaggttggttgctgttgaggttcgtatcctcccatttgtccacgatctgaacgactatccagcatttgcaatacatcgccctgaatttcagtggtataacgatcttgaccgttttgatcttgccatttgcgtgttcttaaacgtccttctacataaacttttgagcctttgcgtaaatattctccagccacttctgcttgacgacgataaaacacgatgcgatgccattctgtaatttcacggcgttcattggtatttttatcaatccaactttcacttgttgcaacactgatattcgcaacagcatcaccgtttggcatggtgcgaatttcaggagcgttaccaagatttccaacaatgattactttatttactccagccataagtcctctaatttgcttcagttaaaaagtgcggttattttgccttaaattaaaaaaaaaagctatgcttaaaatgaactaaactggatatttgcacagttgtttaggaatgtgagataatgatcgcaaaatttacttgattggcttgctattattgtcaatttattgttggtgtattatggaaaaaattgatattcgtggggcaagaactcacaatctaaaaaatataagtttaacaattcctcgtaacaaacttgttgtaattacggggctgtctggttcaggaaagtcttctttggcttttgatacgttatatgcagaggggcaacgccgttatgtagagtcattgtctgcctacgctcgccaatttttatctttaatggaaaaacccgatgttgatcatattgaaggattatctccggctatttctattgaacaaaaatccacttctcataatcctcgctcaacagtgggaacgattactgaaattcatgattatttgcgtttattgtttgctcgagtaggtgagccgagatgcccagaacatcatgttacattaagcgtgcaaactattagccaaatggttgataaagtgctgagtttgccggaagaaagtaagatgatgttacttgcaccggtggtcaaaaatcgtaaaggcgagcatatcaaaattttagaaaatattgccgcacaaggctatattcgggcaaggattgatggtgaaatttgtgatttatcggatccgcctaaattagaattacagaaaaaacatacaattgaagtggtggttgatcgctttaaagtgcggtctgatttggctactcgtttggctgaatcttttgaaacagcgttagagttgtccggtgggacagcaatcgttgcggatatggagaattcgcaagtggaagaattgattttttccgctaattttgcttgccctcattgtggttattctatccctgaattagagccgaggttgttttcttttaataatcctgccggtgcttgttctacttgtgacggtttaggcgtgcaacaatattttgatgaaaaacgtgttgtacaaaacgcatcgatttctttagccggcggtgcgataaaagggtgggatcggcgtaatttttattattaccaaatgttgatgtctttagctaagcactatgattttgatattgaactaccttttgaaaagttaccgaaaaaaattcagcaaattatcttaaacggttcaggtaacgaggaaattgaatttcaatatatgaacgatcgtggtgatgttgttcttcgccatcatagttttgaggggattctcaataatatggctcgccgttataaagaaaccgaatctatgtctgtacgagaggaattgtccaaaaatattagtagtcgaccttgtgtagattgttgcggttcgagattacgttcggaagctcgccatgtttatatcggtgaagctaatttacctgatgtatcagagaaaagtatcggagaagcactcaattttattgataacctgacattgacgggacaacgtggacaaattgcagacaaaattctgaaagagattaaagagcggttacaatttttagtgaatgtggggctgagttatttatctttatctcgttcagcggaaactttatccggtggagaagcacagcgtattcgtttggcaagtcaaattggtgcaggattagttggagtaatgtatgtacttgatgaaccctcaatcggtttacaccaacgagataatgagcgtttattaaatactttgttgcatttgcgtaatctaggcaacacagtgattgtggttgaacatgatgaagatgctatcatggcagctgatcatattattgatattggtcccggagccggtgtgcatggaggaaatgttgttgcacaaggtaatgcacaagaaattatggctaatccaaattctttaacaggtaacttcttgtcaggtaaggaaaaaattgaaattccgctgaaacgaaccgcagttgataagcaaaaaatgcttagattaaaaggagcaagcggtaataacctgaaacaggtgaatttggatattcccgttggtttatttacctgtgtaacaggtgtatccggttcgggaaaatctaccttaatcaatgatactttatttccattggctcaaaatgcgttaaatcgtgcggaaaattcccagtttgcaccttatcaatcaattgagggacttgagttttttgacaaagtgatcgatatagatcaaagtccgataggtagaacgcctcgttccaatcctgcaacctatacagggttatttacgccaattcgtgagttattttccggcgtgccggaggctcgagcgagaggttataatccggggagattcagttttaatgtgcgtggcggacgttgtgaagcctgtcaaggtgatggtgttatcaaggttgaaatgcactttttacctgatgtttatgtgccttgtgatcaatgtaaaggcaagcgttataatcgagaaaccttggaaattcgttacaaaggcaaaactatccatcaagtgcttgatatgacagtagaagaagcacgagtgttttttgatgctattccaatggtagctcgtaaattacaaacgttgattgacgttggtttatcttatattcgcttaggtcaatcttcgacaaccttgtccggcggagaggcacaaagagttaaattagcaacagagctttctaaacgagatacagggaagacgttatacattttagatgaaccgactacaggattacattttgccgatattaaacaactcctgaccgtcttacattgtttacgtgataagggaaataccatagtggtaattgaacataatctcgatgtaataaaaaccgctgactggatcgttgatttaggaccggaagggggaaatggcggagggcaaattattgctaccggcacgccggaagaggtttgcctagttgaaggatctcatacggcgagatttttaaaaactatgttggctaaaaaataacatcataaattagaaaccgtacttcatggattcgattttaataaagtgcggttttttctttgctttttataaaaaagttctgttacaaagggtgtttttttgctaaatttagcacaattttttcgttaagctcggtagagcgtttttatacaatttattagcggacttcttatgttattcaaaaaaattcgtggtttattttccaatgatctctcaatcgatcttggtacggcaaatacgttaatttatgtaaaaggtcaaggtattgttttggatgagccttcagttgttgcaattcgcaaggatagagcaggttcacttaaaagtattgcggcggtcggaaaagaggctaaattaatgttgggtcgtacgccaaaaagtattgaagctattcgtccaatgaaagatggcgtcattgctgatttttttgtcacagaaaaaatgttgcaatactttatcaaacaagttcacagtggcaattttatgcgaccgagtcctcgagtgttggtttgtgttcctgctggagcaacacaagtcgaacgtagagctattcgtgagtcagcaattggtgcgggagcgagagaggtttacttaattgaggagccaatggcagcagctattggtgcgaaattacccgtttcaacggcaacaggatcgatggttattgatattggtggtggtacaacagaagttgcagtgatttctttaaatggtattgtttattcttcttctgtgcgtattggtggtgatcgctttgatgaagctattatcgcttatgttcgccgcacttttggttcaattattggagaaccaacagcagaacgtattaaacaggaaataggtattgcttatattcaaaatgatgatgaagtgaaagaaatggaggttcatgggcataatttagcagagggagccccacgcacatttagcttaacttcaaaagatgttttagaagcattacaacaacctttaaatggcattgtgaccgctgtacgtacagcgttagaggaatgccaaccggaacatgcggcagatatttttgagcgtggtattgtattaacgggtggtggagctttattgcgtaatattgatgtattgctttcaaaagaaaccggtgttccggtaattgttgcagatgatccattaacttgtgtcgctagaggtggtggtgaggctttagatatgattgatatgcacggcggcgatattttcagtgatgaaatttagttttaacaacatgaaaagtgcggtagattttaccgcactttttgtcttaactatttaatctgttgtgataaatcaatctttatgaaacctattttcagtaaatcacctcctttaggtattcggcttattttagccgtggtagtttctatcactttaattctgtttgatggcaaaactagtgcaatgattaatcttcgtggttttatggaaactgcggtaggaagtttatattatttagccaatacgccacgtgttatactggacggtgtatcagaaaatttgatcgatacaaataaattgcaaatcgaaaataaagtattacgtgaacaattacgagaaaaaaatgctgatttgctcttgttggatcacttaaaagttgaaaatcagcgtttacgtttattgttaaattcgccactaagaacagatgaatataaaaaaattggtgaaattttaaccgctgaaacggatgtttatcgccaacaagttattatcaatcaaggtgcgaaagacggtgcttatgttggacagcctgttattgatgaaaaaggtgtggttggtcagattatttcagtgggggaaaatactagtcgagtattattattaactgatgtcatgcattctttacctgttcaagttttacgcaatgatgtgcgtgtaattgccagtggaacagggcgaagtgatgaattgactttagagaatgtgccgagatcggtcgatattgtaaaaggtgatttacttgttacgtctggacttggggggcgttttttagaaggttatcccgtcgcaattgtggaaaatatttctcgtgatagcaaaaattactttgccactattacagctaaacctttggcttctatagaacgtttacgctatattttactactttggccaacgcatgaagatatgcgtaaagcacaatctctgacacctgaagatgttcgtaaagcagtgcaacaacgtctagaaatgcagcataattcttctacatataaggtgaaaaagactccggtacaggaggaattttttccatccaataatgcagatgagtattcagtagatatattagaaaccttaccggaaaatttacctgagcaagagtttctacaaaaagagcagggggatgaaaattaatgaaagtaaaatttttgttacaaattttagtgatcagcggtttgtttatttttacttttgctcttgaacttatgccttggccagtaacttttcagagtttcaaaccctcttggctagtgttggttttgctttattggattttagcgattccgaataaaatcagtattggtaccgcatttatattaggtattatttgggatctaattttgggctcgatattaggtgtgcatgctttggttttatctgtctttgcatatttgattgcaattaatcatttggttttaagaaatttatctttatggttccaaggtattcttactattttatttgttatcgctattcgtttttcaatttttttgatcgaattctttttaaatggtgtacattttaattggcaagcgatttttggagctatcacaagtgggatattatggccttggttatttttattattgcgtataattagacgaaaattagatttaagatagttttgttcttgcgaggattaagtaatcacatgccaataatcacacaatttccaatggagttgactttttctaaagttgtttttgttgtgttatgatctccaatgggaccaatgacaactctgttccagttttcactacgtttaattttagcatcgaaaccggcaatagataaacgtgcttgcatgttttctgcttgagcacgatttttaaaagctccacattgcaagccaaatttcttttccggcgaatttacagtagggttgttttgtatagactgtgctgtttgtaccggctttgcggacacaatatctattttctcacgtcttttatcttctttaattcttgcctgttcagccgctttttgctctttttccatttccagcaaaattttcttttgctcttcgcttaaacgaatatcgttatttaacgattgattattatcaataggaactgttcttgtttctagggctttaatgtaactccatacttcttccggtggggtagggaggacgcttttgggtttttcagattttacgggtacctgtatagttgtattcttcgttttggttttcaaaaaatacaacccagccacaaagccaataatgatcaaaagaatcaaggtaattaagaagattttatgctttccttttgtctgttttttctttttagacttcacacctgttccgtaatcttttgccacaataaaatcctgaataacgagtaagtaataaaaatggcaattctactcaaaaaactataactaatctagtactagctcaaatccagcggatctatatctaaaactaaccgcacttgttgtaatcttaaaaaattttcttgctgaaaagagtgtaaaatttgttgtaattctgctttggatttatgttgtaataaaaggtgccagcgatattgccccgcttttttgctaaaaggtgcttggataggccccaagatttgcaagtttttgcttgaggtattatgaaaataggctgcaatttggtgtaacacttcctcagctttttgtgagtggcgactttgggctttaaacagtgcttgagcactgaaaggcggtaaccccatttggttacgcaaagtgagggcttgttgggcaaagtaagggtaaccttgacttaataaactaaccaataaaggatgttccggatagtgggtttgcaagacgacctctccttgtttttcttctcgtccggctcgtcctgcaacttgaacataaagttgggctaaacgttcttctgcccgaaaatcagtagaaaaaagtgcactatccacgtttaacagtgccactaaagttacattggggaaatgatgccctttggctagcatttgtgtaccaattaaaatttggctttttcctaattgaatatcccgtagatattgttccaattttcctttgcgagcggtactatctctgtcaatacgggtaatcttatagtttggaaaacgttggtttaaactttcttccaattgttctgttcctaaacctgtcgtcactaaatgtgtcgaaccgcaatttacacattgcattggaataggtttttgtgttccgcaatggtggcaacgtagaactcgctgatgttgatgataagtataaggcttttcacaatgttggcattctacaatccagccacattcatgacaaagtagaacaggtgcgaaaccacggcggtttaagaacaataaaacctgatttcccttttttaagtgatttttcatcattgtcaacaaggtttcagataaaccgttatgtactatttgtcgctttaggtcgataaccgaatgacgaagtgcggtagtatttcttgctctttttttgagtgtgatgtgacgatatttgccttgtcgcacattattgatgctttccaaacttggcgttgcagatcctaacacgataggaatatccaattgtttagcgtaaactactgcaagatcacgagcatgataacgccaattatcttgttgtttaaatgaaagatcatgttcttcatcaacgataattagccccagttgtttaaagggagtaaatagtgctgatctcgtgccgatgatgaccgcactttcgccatttttagaacgttgccatactttcaaacgttggttatcatttaaatttgaatgtaacacatcaatttcaatattaaatctcgcttgaaagcgttgtactgtttgtggcgtgagaccaatttccgataccagtactaaaatttgtttctcttgttgtaaaatttcctcaataaattgaagatagatttctgtttttcctgaaccggttacgccttctaataaccaacagataaatccggattgaaaggttaattggctgagtgcaagagcttgctcttggttaaggggaaggcgatcgttagtttttacaatagattgatgatttaatttttgttgccaagagatacttgttttatgtatttcttgttcagatatatatcccttactttttaaggtgctccaaacttggttatgaaaaggattgttatttttttctgtgatattgttttgtagataatgcagagcctcaagctgtttttttgctctttttaatttgttgttgtctaatgcttgttgcccttgttccgttagttgaaagaaaaatgttgatttttctaccgcactttcaccacggcgtaatttgcttggcaagctgcttattaatacttctcctaagggaaattgataatagtccgctccccaatgtagtagacgccataattcaggggtaaaaacagaatgatgatcaagaacggagataatgggtttgagttgtgaaatatctatctccgttttttcaggtaactcagtgacaataccaattaatttttgtcgtccgaaagggactaatactcgacagccgacagcggttgaaagggcatttggaataagataatcaaaaaaactaaacagaggaacggcaagagcaactcgtgcaagtttcattatgttattttccttgcgtagtttgtgtgatttcatctcgtttaacttcatcccaaaaaatatccatttcagttaaagaggtattttcgaaggttttgtgtgcttcacgcaatttttgctcgacggcacgaaaacggcgttcaaattttttattggctttacgcaagctttcttcaggattacattttagatgacgacttaaatttactaccgtaaaaagaagatcgccgatttcttcttcaatttttgtttgattgataggatttgtttgatattcctgtttaacttcttctaattcctcttgtactttagctatcacaggattgacattattccagtcaaaacctattttggcacagcgtttttgtaatttttcggcacgcttcaatgccggaaaagcatggggaatattatctaagattgattgatgtcctttttgaatatattcacttgcttttgctttgttccaattttctaatgcctcgtctgcattattggctttttgttctccgaatacgtgtgggtggcgacgcaagattttttctgtaacggtatgtactacgtcatcaaaagtaaaatattgatcttccgtagcaagttggctaaaaaatacaacttgtaagagcaaatcacctaattcttctttcagatcagacatgttattttgctctattgcttcaatgacctcataagtttcttcaattaaacaagtgatcatcgaacgataattttgctttaaatcccaaggacaaccattattaggatctcgtaattgggcaatgatacgaataaaatcttgaatgtggtagctcataaataatctcatgaaataaatagtatttgaaataaggatatcatagccttgaatgaacaaaaaaatgaaaaattttttaaatttttagccacactgtcccaggaaatgacgatgaactatcatttgataaatatattgggtcgatgagtgcctctattatgtgatgagtgcaccaagactgacaagcatttttttgaatcaaatattaaaaaattatgctcatttctaaaaaaacattttgacatcttgatgtttttagtttgcaagaaaaaagccatagattaacgaggtatttggtttatggagctgacttttattttttattttattcacataaggaaggtattatgttaaagaaattagacccaagtaaagttgttggacttaaaaaccaatcgaactgcaaaacaattatgacaattggtgttcaagacaagaaataactccagttgagaagacactaggttgcaatctagtgtctttttttattaattagattttaaggataatgaatgaactttaatgatatttataatccaaaccagtctttggcgatttcgttgcatagtgcaaataacaaaaagagtgtagattctttttattatttattggatgtctgtgatgaaatcttggatgtaaactccaaagaaaatataataaaaggcatagattttataaaatccaattcgatattgagaggtgttttatttcactttgttaatcatcttgttaagtcaatttctaaaaatgatattgatgaaataaaagatgtatttacttattttaataattttatcttattttatagctgagaaaaaataattttttctggtgtaggaaatataggtaacttatatctaaatcagtttaataaaattaatgatgatgcctatgagttttcttgtgcacctatcaaggatagtttaattaataaatataggttaaaaattaataatcttatgaaatttatcagagatattgatttagaaacctatatggaaattgagaatatagtcgatgatatatatgtatttggtgtgaattttaaagatagtcaagaaatgatttattctggtagtgattttgccaaacttggttgtattttctttaatgaagatattttttttgataaagatgatttgtttatcttggataagattatacatgaatccgctcatcagatattattgtctgtaatgatacatgatgaagttgtgctaaattcagatgatgagcgttatccatcacctcttagaactggactaagaacaatgaatggtatatatcatgcagcttttgttttgtatcggatagcaagatcaagattttttaatcaaattattgagagaaaaaatactcaatatccttataatcatttgatttcttattttaacaaaaataaagaacaatttttggtttgttatgatgttatttctaaaaatggaaaattaacagatttaggaaacgttatcatcgaaaactattataaagaattaaggagtatgtctagtgaaattgacagataagctatctaaaaaaaccattgaattgatgcaaagatttaatgataatgcggtaagaagactaaatgatgatttatatccaatagcaccagatttggtcgaaatgcttattgattcaatttacggtaatgtttatcaaagaggtgttttgagtattaaagaaagacatatagcaacgctatcggcacttattgccattgggggctcagaaaggcaattgtcgtttcaagggtttgctgcttataagcttggtatcacaaaagaagaaatccaagaaatattgatacaaaatgcaatatttagtggatttacgagagcgatgaatgcggctgttgtgcttgatgaagtgtataagaaatatttacaagggaaagatgatgaagcataatgatttttatcgttatcaattagcagaagttatgcttaatactggcataagaactattggatttttgtttgcttggcttatgctcactacctttcatcaacctcagcatttaggtgtttttattggtatttcttgggcgtgtcaggtgttggcattgcttttattttcttgggtgtgcaaccagtctacatttattatttatagtaaaaagttattgttgcctttttgctttatttgttttttgttttttttggcattgttttttgttcataattattttgtttttggcatagtttttatcgttagttctgtttttaccattctcttgaatccattggggacgagtcttaccaatgatttgtatgatggtgaagataaatcaaatggatttaaattgcgtggttttgtgaattctattaataccattatttcccctgctatttccggatttattattcactattttaatacacagaagattattgttttttgtatcctattatctttattaagtggtttcttattttattttataaaaaatataaaattacaagaaaacttgggaaaaaaatctaaaaacacccttaaaatactattgaaaaaccctattgaaaaattgatggtttgtgtatcattattagctaattttattatcactcctattatttcatatattattccttacaatatatccaacaaatttaatttatcggcattttatatcggtattagtgaggctttctttggtatcggtatgataataggtagtgtttattttctaaaattgtttaataaaaaacttggcagtcatcatagtttggtattaagtattttcttggtgatgataggtattttgttttctgtgacagataatttttatattttttgtttttctttaatgacgattggggttggtgttgtgatgtttaatattaacagtacacatattcgctgtacggcaactcccaaaaatattcgtaccagttttgaatttgtttttttagcgtgctgtattgtatttattccaattggcgtattgttaacgacttgggtattaaataatggagctttggtttatttttatggaattatttgtttgattatgttggttttgtctttaatgatttttaaaaatactgatattgttcacattcatcagcttactgatgataagctagatggttattatcaggttttgtatcccaaaatttatccataggtgtgggtgttgtggtatttggattgtggcactgccctagcaggggcggaggtagagtatcaagacaaacaagtgatcatcgaacgataattttgctttaaatcccaaggacaaccattattaggatctcgtaattgggcaatgatacgaataaaatcttgaatgtggtagttcataaataatctcatgaaataaatagtatttgaaataaggatatcatagccttgaatgaacaaaaaaatgaaaaattttttaaaacgtgatctggtgcaaatttttttatttttattaatgctagtatagttccaacagttagttaaattcattaagctaaggaggcaattatgtataaacacgtattagtggctgtagatctttcagatgaaagtggatttttactcgaaaaggcagcaaaaatagcaaaacaatatggtgctaaattatcggttatccatgttgatgtgaatttttcagatctttatacgggtttaattgatgttaatatgtcttcaatccaagatagaatttcaactgaaacacatcaagccttgattgagttatcagaacaatctacctatcctgtttctgagaaattgagtggtagtggtgatttagggcaagtcttatctgatgctgttgagcaatatcaggttgatttattagtaacaggtcatcatcaagatttttggagtaagttaatgtcttccactcgtcaagtgatgaattcaattaaagttgatatgttagttgtaccgcttagagaagaataaatataaagaatttgtgatgggcagcgtgagttgcccttttttattagcattgaaatattgttttgcataatgcgttattacttcttgagagaatatgaataatcagctaaaaaagttttttataaatgtcaaaaatatgcaacaataagcaggttttttactggatttacaagatataacaaggttttttaatgaaaacaacagcagaaattagacaggcttttttggattttttccatagcaaaggacatcaaattgtagatagcagctctcttgtaccggaaaatgatccaacgttactttttactaatgcgggaatgaatcaatttaaggatgtttttcttggattggatacccgttcttatacgagagcaactacagcacagcgttgtgtacgtgcaggcggtaaacataatgacttagaaaatgttggttataccgctcgtcatcatacttttttcgaaatgcttggtaattttagttttggagattatttcaaacaagatgctattaaatttgcttgggaatttttaacttcaccagaatggctcggattaccagaagaaaaactatatgttactgtttatgaaactgatgatgaggcctatggtatttggcataaaggagttggtgtgccggaaaatcatattattcgcattggtgataataaaggtgccccttatgcttctgataacttttgggcgatgggtgatacaggaccttgcggtccttgcactgaaattttttacgatcatggtgagcatgtgtggggcggtttaccaggtagcgaggaagaagatggtgatcgttatattgaggtttggaatattgtatttatgcaattcaatcgattggctgacggcacgatggaaaaattaccaaaaccttccgttgatacggggatggggttagaacgcattagtgcggtaatacagcatgtaaattcaaactatgatattgatattttccaaaaattaattgctaaggttgcagaactgacgggggaaaaagatttaactaacaaatcgttgcgtgttatagctgatcatattcgttcttgtgcctatttaattgcagatggcgttattccttctaatgaaggacgtggatatgttttacgtcgcattatccgtcgtgcggttcgtcacgggcatttattaggtgctaaagacactttcttttataagctcgtaccggttttgatcgatgttatggctacagccggtaaagatgtaaaagcgaagcaagccaatgtagagaaactgctacgattagaggaagagcaatttgctcgtactttagaacgtggtttagccttgttagatgaggctttaattagcgtaaaagatggtgtgttatccggtgaagtagcatttaaattatatgatacttacggttttccattagatttaactgccgatgtttgccgtgagcgtaatattcgtattgatgaggaaggcttcgagcgtgaaatggaagtgcaacgcttgcgtgcacaggcggcaagccgatttggtgtagattacaataatgttattcgtgtagaagggacaactacttttgaaggttatactgaggctgaaactcaggcaaaagttaccgcacttttctatgaaggcaaatccgttgagagtattagtgcagggcaaagtgcggttgttattttagatgatacaccgttttatgctgagtccggcggacaaataggtgatagaggttgcctgattgcgacaaatatgcggtttgacgtgaaagatacgcaaaaatatgggcaagtttttggtcatatcggtacgttaattcaaggcacattaaacgttggtcaaacaatcaatgctgttgttgatacggaacatcgtacaaaaacttcattaaatcatagtgctacgcatttattacatgcggctttacgtcaagtattaggtactcatgttgcacaaaaaggctctctcgtatcagatactatattacgttttgactttgctcaacctgaagcgattagccaagaacaattgtttgaaattgaatgcctcgtaaatcagcatattcgagctaatcatttggtagtaaccgaagttatgcctattgatgaagccaaagctaagggggcaatggcattatttggtgaaaaatatggcgatgtagtgcgtgttgtgaaaatgggcgagttttctattgagctttgtggcggtattcatgtaaaacgtacgggtgaaattggtctatttaagattgtttccgaatctgctattgcggccggagttcgacgtgttgaggcagtaactggagaggttgcaattaattggttgcaacaacagcaacagatcttaatgcaaagtgcggatcttttgaagtctgatgcaaattcattagtcgaaaaaattcagcaattacaagataaagcgaagaaaacagaaaaagagttgcaagcactaaaagaaaaatctgcgatgaaggcgggttccgatattgctaaaagtgcggtagaaattaatggtgtttctgttattgttcaacagcttgaaaatatggatgtaaaatctttacgtgttattgtcgatgatttgaaaaatcagttgggatcagcggtaattgcttttgttacgaagaacgaagataaggttaatctagttgttggcgtgacaacggatttaacctctaaagttaaagcaggcgaattagttaatttaatggcacagcaagtgggtggtaaaggtggcggacgtcctgatatggcaatggcgggtggatcacagccggaaaatatctccaaggcgttaacagtttgtaacgaatggttacataaaaatttataaagtaaaaattttgtgttgtggctcacatttttgaatattattcatctctttgtgggaataaataacgtacaatgtaagtcggataacacttcattattatcatgctttattattataacgctttgttatttaaggattttaagcaagatagagatcttataaattcaactgaaatgagagggttatatgctgatattgaccagaaaagttggcgagagcttactcattggcgacgatatttctatcacaatattaaatatacgtggcaatcaagtaaaaatcggtgttgaagcaccgaaagaggtttctgttcatagagaagaaatttatcatcgtattagagatgttaaagatgaacagcagttgtaattggctttttgaacgataagatatggagaaattatgagtaaactaacttgttttaaagcatatgatattcgaggtcgtttgggtgatgaattgaacgtggatattgtatatcgtattggtcgtgcatttggacaatttttaaaacccaaaacgattgttgtcggtggtgatgttcgtttaacaagtaaagaattaaaaagtgctgtaacaaatggtcttttggactcaggtgttaatgttattgatttgggagagacgggcactgaagaggtctattttgcgacttcattcttaaaagctgatggtggtattgaagtaacagccagtcataatcctatggattacaatggattgaaacttgtacgtgaaggttcgcgtccgattagtgcagatacaggtcttgcagatattcaacgtcttgcggaagaaaataattttgctccagtttcccaacgtggggagtataaacaactttcagtattagggcattatattgagcatctcttatcttacattaatttggaaaatttaaagccaatgaaattggtgattaattcaggcaatggtgcagcaggtcatgttattgatgctattgaagcacaattccgagctaagcatgtgcctgttgaatttgtgaaagttcacaataatccggatggtactttcccgaatggaattcctaatccgattttgcatgaaaaccgtcaagatacgattgatgccgtgttagagcataaagctgatatggggattgcttttgatggcgactttgaccgctgtttcctatttgatgaagagggcggttttattgaaggttattatattgtgggattattggcacaagcatttttacagaaaaataaaggggctaagataatttatgatccacgcttaatttggaatacgattaagttagttgaagataatggcggcgaagcggttatgtctaaatccggacattctttcatcaaagaaaaaatgcgtactgttgatgctatctatgggggtgaaatgagtgcacaccattatttccgtgattttttctattgtgatagcggaatgattccttggttgcttgttatggagttagtgtcaaccacaggtaaatcactaggtgagttagtggggaatagtcttgaaacctatccatcaccgggtgaaattaacagtaagttagttgatgcgaagtctgcaatagagcgtgtgcgtgttgcttatgaaaaagaggcagtcagtgtagatgaaactgatggtatcagcattgagtatccaaattggcgttttaatttacgcagttcaaatacggagccggttgttcgtttgaatttagaaacacgaggcgataaacaattgatgacagaaaaaacagaagaaattctcgctttattgcgtcaataaattaaacttaagtaagaccgcactttgtttccgcaaagtgcggttatttatggctctaattaaggaaattaaaatgaaagtaattattcctgttgccggcttaggaacgcgtatgttgcctgcaactaaagcaattcccaaggaaatgttaacgttggttgacaaaccgttaattcagtatgtcgttaatgaatgtgttaatgcagggattaaagagattgtgctggtaacgcattcttccaaaaatgctatagaaaatcattttgatacatcttttgagttagaaactatgttggaacagcgtgttaaacgccagcttttagatgaagttcgttctatttgtccgacaggcgttactattatgcatgttcgtcaagggaatgctaagggactagggcatgctgtactttgcgggcgagcaattgttggcaaggaagcttttgccgttgttttacctgatgtattacttgctgaatttgatagtaatcaaaaaacagaaaatcttgctgcaatgctgaagcgttttaaagaaacgggaaatagtcagataatggtttcacctgtacctgataaagatattagtagttatggtattgttgattgtggcggtgttactttaaatgttggtgagagtgttaaaatctcaaatattattgagaaaccctcatttgaggacgcaccttccaatttgtctgttgttgggcgttatgttttttcagcgacaatttgggatctattggaaaaaacgccagttggtgtcggtaatgaaatccaattgactgatgctatcggtatgctaattgaaaaagaaattgttgaagcatttcatatgaccggcaaggcttttgattgtggagataaaataggatatatgcaagcctttgtggaatatggtttacaacaccctcaattaggggagaattttaaaacctatttgaaacaactggtgcaggacttgtagaaattcgttatggctaaactttgtcggttctttaatataaaattttattaagggaccgattttttgtgattaaaaacagctatcaattcatttactttaattcttttgtgagatgatttgctaatagaacgctgaacttttaagcgtttaatttttgcgtctttgtagatctctctagtaaatttggtatcgtggttagagattaagaccggtacaccgtggtttagtgcggtatcttttgccagttgagctaaattttgttgatgagataaagaaaattcattgcctgagtagctggtaaagtttgagttttgtttcaatggtgcataaggcggatcacaataaataacagaatcattattgatcattgaaaatgcttgttggaaatcagcacaaataaacaccgctctttgtgctttttgggcaaaataacgtagttcagactccggaaaataatgtgttttataactaccgaatggaacattaaattcatttttagcattatatctgcataatccgttgaaaccatatctatttaagtacaaaaacaaaaccgcacgttcaaaaatattttgcgataaattaaattcagctctgcgatggtaataataattagcggtattagcttgatcatggaaaaatactggtttgcatgccgcaatataatgttcaacatcttgctttacaatattaaatagatggatcaagtcagggttaatatctacgagaatatagtgttcaaaatgagtatttaagaatacagaaccagcaccgacgaaaggctcaataaggcaagttttatttttaggcaaaagtttgttaatttcctctgttaagcgaaacttaccgcctgcccattttaaaaatgggcgatatttcactaaattagaagaagttcctttgttggacatgaaagattaacttttttttgaacaggtacgaattgcatcaagcacgtattctttgtctgtatctgttgcaacgtaggcttgaccaagtgattttagtaagactaggcgtaattttccagcaagaacctttttatcacgcatcatatgtggtagataatcttcagctttcattgtatcaggtgaggctgtaggtaaatctgcttgagttaaaagtttctccagtctcgttacatcgttaagtgataaatcacctaattgattagacaagacggcagctatcatcattccggttgcgactgcttctccatgcaaccaatttccatatccaaggtgagtttcgatagcatgcccgaaagtatgacctaaatttaataacgcacgctctcctttttcagtttcatcacgagtaaccacatctgctttaatttgacaacagcgagcaatgcactgctgtaaatattgttgttctaaagcaactaaattagttatatgtttttctagccatgtaaaaaattcatcatttaaaatagcaccatatttaatgacttcagctaaacctgcgtgaatttcccttttaggtaaagtagttagcgttagcgtatcaataataacggcacaaggttgataaaaagcaccgatcatgttttttcctaatttgtgattgacagccgtttttcccccaacggaagaatctacttgagcaagtaatgtggttggaatttgaataaaacggataccacgttgatagcttgccgctgcatatccggcaatatcaccgatcacaccgccacccagtgcaataatagaggtatctcgtccatgattagcttttaaaagtgcggtaaaaattaagtctagagattctaaagttttgtattgttcaccttctgggagttgcacattctctaccgagcaaccaattttttctaaggtgtctgttacagaggataaataatactgtgcaattgtagggttagttacaatcatcactttatcgcctttttttagcggataaacttgtgcttcggataacaaccccattccgatatggataggataactgcgttcccttagttctacatttacacacagcattttatacctcaaaatgtaattagattttaagattatcaattaaatcaatgatttgattcgccattaatttggcactttgctcgtctgtcggcaaaataatatcagccacttcttcatataaagggttgcggactttggctaaatcttctaatacttggcgaggatcttcaacattttgcagtaatggacgttttttatcacgttgagtacgttggaattgtttttcaacggtcgtttctaaataaataacggtgccacgagcagataaataattacgattatcttttgatacgattgcaccaccaccggtagaaagcacaatgccttgtttttgagttagttcattgatgatacgttcttcgcgtttacgaaaaccttcttcaccctcaacgtcaaaaatccaactaatatctgcacctgcacgttgttcaatttcggcatcagtatcaataaattccatgcctaaaatttgtgctaattgacgaccgattgtactttttccagcccccataggacccactaaaaaaatattacgtttttctgccatttgtacttcttctttacaaataaaattaaaaaattgatcttataaaaaacaaacgacctaaaataaagaggtcgtaaaagatcgcccaaaaataatggagattatctcaataaatgcccccttttttcaacctaaaaggggatttattttaagatttcattaagtgcggtttattttaatactattttaatggttttattatttcatcaggttgttctgaacgaatgatccttggggtaacaaaaattactaattcacgtttttggtgtctttcactttcacggctgaacagtctttttaatataggtatatctcctaacaacggtactttatctactccttttgtgattgtatcgtgaaatacgccacccaacacaattgtttccccatctcgtgcaaaaacttgagtattaatttcttgtttatcaatagataccatttcattttgcccataagtaatacgacttccaggggagttttggcttacaaggagatccagcaaaatagtattgtctttagaaatgtgtggcgttacttctaatcctaaaactgcttctctaaactctactttctgttcatcagatttcttgccggtaataacataaggaatttcagttccttgtttaatacttgcactttgcttattcgttgtaagtaaacgagggcttgcaataatttctacattattttctcgttcaagtgcggtaagttctaagtctaaaagtcgatcattaattttggcaatttgtaaagcaatagaacctgcaggtgttgcggtagtagcaaaattgacgttaagttgttccgttaaatgctgaaatccgtttgccgctagattgcctgaaagatgatgagcgttatttgtaggctcaaaaattccccaacgaacccctaattcttttaaattttcatcactaattgttacaattctcgcttcaattgcaatttgttcaataggttgatccatttctttgattaatttttttaaggcattgagagtttcctgattatcctgaattaagagcaagttacttcgttcatcaaaactaaaagttccatttgatgaaagccatgaaccttgacctgtagtcagtgatttcattacatcagccgctttagcataatgtaatttgatcgaagtcgtcgttaaatttggctcattagtcgattttgacaaattttcctttgtatctaattgtatatttgtctctttttttatgcttctttgtcttttatcaaagggatctctagcagataattccacacttactgtgaataagaacaaaaagaaatataagaaatttttaattaacataggtattctccatgactaaagttgtaaagaaatatcggcttgaatggaaaaatcttcattttcactatgagaaatttgcaacgaaactaaattgagtggaacttgaggtaaaagagcggttaaaaattgagataaatcggaaaaatagcctttaacgtgaaaagttaaaataggttgatttcccatttgccaatgagattgttcaaataataattttccattatttaacaattgtaatttttgattaatttgtgcaagaggtttattaaactcaatattattttgttgatagcgttcctttaagctggttaatatttgttgcctgtgaacaagtcgagcatttttttcgtcaatttcaacttgaagtttttgtgcaatttcttgttgctgaatataattgagcgagggataaattgagcttatcaaaattattaagaaaaaaattaaaatttgttttagtgaagataaatttacccattttactaacaaattatcagaatgctgtaacttcatgatctattccttatgttgagttaaacttaattcaaattcaaatatgactgatcttctctgatcaatttgttgttctttaaatgtcaacagtcttacacttgaaaacaaattttgttgtttcaagaatttttgtagctgttcaacttcattatttttctccgtttcaccttgcaaaattaatttttcaaaatctaaggacagctcgtttaattccccactttgtaacggaagtttagaaattgttgttaatattgataaaaattgttcattcggtaatttttttaagttttttgatttaccgccataatttctttgtaatgtagaaatgttctgttttatttctgcaagtttattgtcaatttgttgtatttgctctctttttttatctatttcggtgtcaattttttgagttaaataaagtataaaagtcacaccagcaagacagataatgaggctggcaagtgatttataaataaacgattttattttttgtcgataaatttcttgtcgccaaggtaataaattaatttcaatattacgcatttattattcctttaattccgttatttgatagagttcatttcttccccaaagagcatttcctaaagcaataaaaggcaattcggtattaatgatgttccatttatgagtgatattttgttgttcatttttttcacaatagcaccaaacttgttgaggttggcagttaaaacgttggcagaattcttgataaagtgcggtaatatttttgtcatttttttgtagaacgattgtttgttgtccgatttcttgtattgctatacagccgttacgatcctgatataaatataatgtttccatcttttcttttggggggtgaaaataatggaatgctcgtagtaggctattgcttaagcaatctaacgtattaatttttatagggaaaaaacgatgcacataattttgagctgtttgttttctaacaacatagatagccagttttgcaccttgtgttaattctttatattggtagtcgtaccaaatatcaccgaaatctgtcggcaattcattttctatgattaagttacattgttgttggcattcttgctcatttaacttttgcgtcaatatgattgtttttacccagacgtgctgattgggtaaacaggctatccatgtgcagatattctttgcgaattgtggtgtcaaatcagatagtttaagagggggattatcgtttttagttaaaaagtgcggttgtttttgttcatcaaaccagaggaattgccattgttcatcttgtctatgaataccaatttgtaaaatatttgctgtttttttgttaggtctcatttcatattctctttaataaaatttatattttaaaacttagctttattagctaaatcctttatacttacctcattgattatcgatatatttttttcaaatacattaaataagagagaattttacgatgaggatcgcaaaattaatatttagtaccttactaacgttgattattttagggtgtgttgtagtcggtattttttacattcagataaagaaagatttgcccagtgttgatggtttaaaaacagttgagttacagcaacccatgcaaatttatactgctgatggaaaattgattggtgaagtaggggagcagcggcgtattccggttaaattgcaggatattccacaaaaattaattgaggctgtattggccacggaagataatcgtttttatgaacatcatggattagatcctattggtattgctcgagctattagtgtagctatcagcaaaggaaatgcttctcagggagcaagcacgatcactcagcaattagcacgcaattttttcttaacaccggaaaaaaatcttgtccgtaaaattaaagaggcaattttagccattgaaattgagcatgttttaactaaggatgaaattttagagctttacctaaataaaatttatttcggttaccgtgcttatggcgttgcggcagcggcaaaaacctatttcggtaaagaattatcgcagttaactttatctgaaatggctgtcattgccggattgcctaaagcaccttcaacaatgaatccaatcagttcattaaaacgtgcacaggatagacgtaatgttgtattggggcgtatgcttgagacgaactatatttctaaagctgaatatgatgcggcgataagcgaacctattgttgcctcttatcatggaacacagttagaatttcgagctgattatgtgagtgaaatggtccgtcaagaaatggtaagacgctttggcgaagaacaggcttatacgaaaggatataaggtattcacaacgattttatccaaagatcaggcacaagcacagaaggctttacgtgagaaccttattgcttatgacatacgacatggttatcgtggtgcggtcactttatggaagaaaaatgaaaaggcttgggaaacagaggcgattgtagcacatctaaaatctttaccaaattctaatccatttattcctgctgctgttctgtccataagtaaaacgggagctaacttgttgttagcggatggtaagaatattactttatccaacaatgcgatgcgttgggcgggtaaaaaaatgcctaaagaaggtgatcaaatttgggtaagacaacagaataaagaatgggttttagggcaaattccggaagctaattctgcattagtttctcttaatagtgataatggggctattgaagcgttagttggcggttttagttttgagcaaagtaaatttaatcgtgccacacaatccttggtgcaagttggctcatccattaaacctttcatttacgctgctgccttggagaaaggattaactttatcaagtgttttattggattcggaaattgttattcaaaaaccggggcaagaaccttggacacctaaaaattcaccaaatcgatatgatggtccaactcgattacgtgtaggattaggattatcaaaaaatatgatcgctattcgtgcgatccaaatggcaggtgttgatttcagtgccgagtttttgcaacgttttggttttaagtcggaaaatatttttgccagtgaagcgatggcattaggtgcagcctcttttactccgttggagatggcaagggcttacgcagtatttgataatggcggttttttagttgatccgtatttaattgaaaaaattcaagataatatggggaatgatgtatttattgcgaaccctaaaatagcttgtatcacttgtcatgatattccggtaatttatggagaaacagagaaattagacggatttaaagagaatacatctatatcggataatgccaatgccttagatttagggggggaggaagtcagtgaaattactgatatacccgaattaaatacggttagtaaaaaattagatgaaagtgcggttctctttatggctgaggcgaagacggagcattcgacggaacaatatgcacctcgtgtgatcagtggtgaattggcttttcttattcgtagtgcattaaccagtgcggtctttggtgaagaaggacttgattggaaaggaaccagttggcgaatggcagaacacttcaagcgtcgtgatattggcggaaaaacgggtacaaccaataattctaaggttgcatggtatgcgggatttggtgcaaatctagccactgtggtatatgtcggatttgatgataataaaaggagtttaggaagaggagaaacaggctcggcaacagctatgcctgcatggatttcctatatgaaattcagtttaaacgatattccggaaagaaaacttgccttaccgccaaatatagtggaaaaaaatattgatgttagatccggtttattggcagaaacgggagaagggaaaatagaatactttattagaggtacggaacctaaaagaacattcgttcaacaaggacgtggttactaccttccttctgaaacggatctgccaagtgcggaaccggaagaaattttctaaaacaaaccgcactttgtaaaagtgcggtctatctttcattattttataaggctaagtttatgctaagttatcgtcacagttttcacgcaggtaatcatgctgacgtgttgaaacatattgttttaatgttgattattgaaaatttaaaattaaaagaaaaaggattttattatttagatacacactctggtgtcgggcgttatcgtttattcggtgatgaagcggaaaaaacagcggaatatcgagaggggattgctcgactttgggcaaaagaggatttacccgaggtaattcaacgttatatttctttaattaaaaagctgaattacggtggtaaagaattacgttattatgcaggttcgcccctgattgccgcacaacttttacgctcacaagatcgtgcattgttaacggagttacatccggcagattatcctttgttacgcaatgaatttaaggaaatcaataacattagtacaaagcgggataatggttttcagcagttgaaagcgactttaccgcctaaagaacgtcgaggtttgatcttaattgatccaccttatgaactaaaagaagattatgatcttgtggtaaaagcaattgaagagggatataaacgttttgcaactggtatttacgccctttggtatccggttgtattacgacaaaaaactaaacgaatcatcaagggcttggaaaatagcgacattcgtaaaattttgcagattgaattagcggtacgtccggactccgaacaacgaggaatgactgcaagtggcatgattgtgattaatccgccatggacattagaagatcaaatgaaaaaaatcttgccttatttgacccgcactttagtaccagaaggaaccggtaattggtctgtaaaatggattacgccggaatagaaaataccaatcaaattaatttattcaggcatttggtttttttggcaaatttttagcagaatacataaacttaaatataggagagaaaaatgactaaacattatgattatattgctattggtggtggtagtggcggtattgcttcaattaaccgtgctgcaagttatggtaaaaaatgtgcaattattgaagcaaaatatttgggcggtacttgtgtgaatgtcgggtgtgtgccgaaaaaagttatgttttatggtgcacaagttgctgaagctattgcaaaatatgcacctgattatggttttgatgttacgttaaatcattttgattttgccaaattggttgaaagtcgtcaggcttatatcgatcgtattcatacttcgtacaacaatgtgcttgcaaagaataatgttgatgtattaaatggatttgctaaattttttgatgcaaaaaccattgaagtgagttatgcaaacggcgaaaaagagctggttacagcggatcatattttaattgctaccggaggacgtccgagtcgtccgacaattccaggagcagaatatggtattgattctgatggtttttttgcgttgaccgaattaccaaaacgcattgcggtagttggtgcgggttacattgccgttgaattggcgggcgttgttaatagtttaggtgcggaaactcatttatttgttcgtcggcaaacgccaattcgtagctttgatccgctgattattgaaactcttgtcgaagtaatgaaacaagatggtattcaattacatacgcaagctattccacaagaaattatcaaaaatgcggataattctctaacaattaaattagaagatgggagaacgcaggacgtagattgtttaatttgggcaatcggtcgggaacctgccactgatgtgattaatttggcttcaacaggtgtagaaactaacgaacgtggatttatcaaggtagataaatatcaaaatacgaatgttgaaggtatttatgccgtcggtgatattattgagggaggaattgaattaacgccggttgcggttgcggcaggtcgtcgcttatctgagcgtttatttaataataaaccggatgagcatttagattaccatcttgttccgacggtagtatttagtcatccaacgataggaactgttggtttgactgagcctaaagctattgaacaatacggtgcggaagcagtgaaagtttatacatcttcttttacaccaatgtatagtgcggtgacttcacaccgtcagccttgccgtatgaagctggtttgtgttggtaaagaagaaaaaattgtcggtttacacgctataggttttggtgtcgatgagatgattcaaggttttgccgtagcgattaaaatgggggcaactaaagcggactttgataatactgtcgctattcacccgacaggctcggaagaatttgtcactatgcgttgataaaagtgcggtattaattaatgaaaaaaggattgttctctaccttagaggtcaatccttttaatagcgtatcttgatttagaaagatattctcgagctttcaaataattagacataaaaaaaataactgttatactgatcaacgagtggagaattcggtttatcttcaatctatctcctataattagtataagaaggaaaagaaaatggcaaaaggacaatcactacaagatccttatttaaacgcattacgtcgtgaacgtattcctgtatcaatctacttagttaatggcatcaaacttcagggtcaaatcgaatctttcgaccaatttgttattttattgaaaaatacagttaaccaaatggtgtataaacacgcaatttcaacagtcgttccggctcgttcagtttctcatcataatagtgttcagcatcaccatattgttcaaactcaagaaatgcaagcggaagcattagctgaaaatcaaactgaataattttgaatacaaacaagcaattcaaagtatataccgcaagtgcggttgattttgcccaagatcctaccgcactttcttccaacataaatgtgcctcaatttgacaaagcaattgtggttcatgttttcttttctcaaaataaaaatctagaggatttacaggaattccaacttttggttaaatcagcaaatgttgatattctttcaataatcacaacctcacgctccacgccacaagctaaatattttgttggacaagggaaggcagaggaaattgctcaagctgttgaacaactcaatgcggatattgtgttagttaatcatagcttaacacctgcacagactcgtaatttagaaagtatctgtcaatgtcgtgttgtcgatagaacaggattgattttagatatttttgctcaaagagcgaggtcgcatgaaggaaaattacaagttgaattagcacaactcagacaccttgcaactcgtttagtccgccgaaaaacaggattagatcaacaaaaaggtgcggttggattgcgtgggccgggtgaaacacaattggaaacagatcgccgtttaatcaaagttcgcattactcaattacaaaatcgcttagaaaaagtagcaaaacaaagaaatcaaaatcgtcaaactcgccgaaaagctgatattccgacaatttcccttgtcggttatacgaatgcaggaaaatccactctatttaatgtgctaactcaagctaatgtttatgtggcagatcaattatttgcaactctagatcccactttaaaacgtttaccaattcaagatgtagggaactgtgttcttgctgatactgttggatttattcgtgagttgcctcatgacttggtttctgcgtttaaatcaacattacaagaaactactgaagcaagtttattgcttcatgttattgatgtcgcagatagccgtaaattagaaaatatgttgacggttaatgaagttttaagtgagattaaagcaaaccaagttacaacacttttagtgtataacaaaattgatcaagtcgagaatattcaacctcatattgaatttgatgaagaaaatcaaccgattgctgtttatctttctgcacaattaaatcaaggtttggatttattagttgaggctattcgacaaaaattaagccacgaaattctacatttagagatcaatcttgctgcacaatacggtaaaattcggcattgtttttatcagcttaattgtgttcggcaagagaaaatcaatgaacaaggtgaattcttacttgatgttcaaattgataaaattgaatggcttaaattaagtaagcaatttccgctattgaaacgtttttatgaatcaacagaaatcagcgacaaataaaccgcactttttaagtctatttgacaattccgtattgttttaatttattggcaatggctgtatgcgacatccctaaacgggctgccaacttacggctacttggatattgctcataaaatttttgtaacaccattgactcgaacttattcattatttgttctaaggtttcaccggcaaattgatcaacattaaccggcaaaatttcttgctctgataagtttaaatcagcaattgccaactcattatttttggctaatgagcaagctcgatataaggcattatataattcacgcacatttccagcccaagtataatttttcagatattgaataaaccgctcattaaagtgcggtactgaaatagaaagtttttcactaatttgacgaataaatatttctgtgagaggctcaatatcttctactctttcacgcaacggtggaatagtcaaacttaaaacatttagacgatgaaacaaatcttcacgcattttaccttgttcaacatagtgttgtagcggaatttgcgatgtgcaaattactcttacatttgcacaatgttctttttcctcgccaacacgacgaaaagtaccatcgtttaaaaaacgcaacagttttgcttgtagctctaaagaaagttcagcaataccatctaataataccgtccctctattggcatattcaaaaaagcctgttgtttcaattcccttatccaaacgaccgaacatttcactttctgcatcttcagcaggtagccccgcacaatttatggcaataaacaagtgatccttacgaggaccggcattatgactggcttttgcaattaagtctttccctgttccggtttctccttgaatgagtaaaggtgcgtccaatccggcaaaagcttttgctgtttcaattaacgtctgcatttttacacttttacatacaatatcatcaaaagaaatcagctttgtcataatttaccccatttaaaatcaattgattttgtattctaaacgttgaacaaaaaatgtaaagaaaaatgaacaccaaagataaaaatgtttactcttgatctacatcacaaaaccgaacatttacaggttcagtcagttccaacactactactaaagtgttaaaatctcctcaaatttttaaattcactttaatagcgaggtataaaatggcatttcgtatcgaaaaagacactatgggcgaagttcaagttcctgctgataaatattgggctgcacaaacagaacgttctcgtaacaatttcaaaatcggtcctgaagcttcgatgccaaaagaaattattgaggctttcggttatttaaaaaaagccgccgcttatgcaaaccatgatttaggtgtgttaaatacggaaaaacgtgatttaatcgctcaggcttgcgatgaaattcttgccaataaacttgatgaccaattccctcttgtaatttggcaaactggttcaggcactcaatcgaatatgaatgtcaatgaagttgttgcaaaccgtgcacatgtcattcaaggcggtaaattaggagaaaaatccgttattcacccgaatgatgatgtcaataaatcccaatcttcaaatgatacttatcctaccgccatgcatattgccgcttataaaaaagtggttgaacatacgttaccttgtgtcagacgtttgcaaaaaacgttagcagaaaaagcagaattatttaaagatgttgtaaaaattggtcgtactcatttaatggacgctacaccattaactttaggccaagagttttcggcgtatgcggcacaacttgctttcggtatcaaggcactggaaaacaccttaccgcatttgcgtgagcttgccttaggtggcacagctgttggtacagggctgaatacacctaaaggctatgatgtaaaagtagcggaatatattgctaaatttacagggttgccttttgttaccgcacaaaataaatttgaagctcttgcaactcatgatgcgattgttgaaactcatggtgccttaaaacagttagcagtttctctttacaaaatcgccaatgatgttcgtttattggcttcaggtccacgctcaggcattggggaaattctcattcctgaaaatgagccgggttcatcaattatgccgggtaaagtaaacccaacgcaatgtgaagcaatgacaatggtttgtgcacaagtactaggtaatgatgtcactatttctttcgcaggtacacaaggtcatttccaattaaatgtgtataaacccgtcatggcatacaatttcttacaatcggcacaattattaggtgatgcttgtgtgtcatttgatgaacattgtgcaatgggtattgagccaaactatccacgtattaagcaacaactggagcaatctttaatgttagttaccgcacttaatacgcatattggttatgaaaatgcagctaaaattgcgaaaactgcacataaaaatggtacaacattgaaagaagaagccatcaatcttgggttggtgagtgcggaacaattcgatgaatgggtacgtccggaagatatggttggcagcttaaaatagttcacttattgaacatttaactaaggcgagatgagttctcgccttattttttactacaatagctttaacttaacattattttttataactgaattggttccaattttgatttttgttccgtagttaaaacatctgttgaaataatatgtaatccggttttgttattcagtcccaaatcagcatggaaataatcaggtaatttgtacattgcacctgttataggatcaacaataagtaacccaattaagcctccaaatacaaagtttccaatataccaaccatcaagtttcgcttctaacagaaaagtttggcttttggcatttttaccttcaggggtaaaagtaatttcatatttttcgcctttgaaatatccggctcctgctggtaagacaacattttgaggtgtttttccggatgtaataacttttccagctctattttttatcacaaagtaggcattactagggtttgattgaattgaaacattataatcgcgtttactcacgatagttgcacaaccggtagcaaacatagcgacaaatgctaatactgataattttcttaatcttttcatggataaatcctcttaaatgtgtaaaatggtaacaattatactaatctgtctattagtgttcgaagttagattttaggtaacaatctatattttgactagaaacgaataagataaattactacctaaattgtgattaaaattacccaatttgtgaggttctcatggcaatgcataataaaattcgcctgatgcgggaagtccgccaatggtctcaagaagaaatggctcataaaatgaatatgtctctaagtggttatgcaaaaattgaacggggcgaaacaaagttgcactatgataaattggttcagattgctcgtatttttaatatgaacttagcggatctgatagatattgataaaggtgtaattttttgtatgaatgagaacagtgattatatttatacaaattatggcaatatgagtgaatcatcgttaattgaaatcgaaaaattaaaactgacgcttgcacataaaaatgagttgcttattcaaaaagaaaaagaaattcaatcacttaaaaagattattaccctgttggaaacttcaaaataaggcatttctctgatgtgtcgttgattggcaagaacaccactttaaaaattacctgttggcgaaatgatatatgttttaattactttgctggatcataatattccgttatgtgttcttttagtgagccggttgtccgaaaaaattcattggctgataaaatagcttaaattttccagcatttcattaattatttaaccttttatctgtttgtctttccctttaaaagtgtcttattttatcaatcatctttgtgaaatttttgagaaaaatttgaaatgatatcaaatgcttctgtaatcattcgcctgttgtaataattgccgactttctttcaaaaattgctctgaatactcaccaaaccattcccgcacttgattaaaacagtctataaacccctgcttgttattatgttcaaagaaatttagactttcttcatagctttgttttagactcttaatcacttccaaattctccgatttgtccataataatatctgcataaagttccgcatcttgagcaaataaacgtccgatcatggctaattcaagacgataaatgggtgaagatagggcaagcaattgtgccaactcaataggttgttttgataaatgcaaaccatttgcaaaggttgaaaaatgacgtaaggcttgtacatacgtcatacttttatcatgttcggttgcatcaacttgataaattttcgctccccacatttgaatttgttccaaaaaccattggtatttttcagggtagcgaccgtcacaacgtactaccacttgctttgccatattggtaatatccggaccaaacattggatgtaatcctaatactgcaccttgatgcacttgtaacattttttccaacggttgacgtttgactgatgttaaatctgttaatagcatattttcggttaaataaggcttcagacggtcaatcacatttaaagtttgtgcaattgggacacaaacaataactacatttgcattttgtaaaattttatccgcactttgccaatcctgtttctctaagacagcaatttgataaccggaagaagacaaataacgagcaaataatgcccctaatttcccctttcctccaacaatgacgattttttttatttcaggatttgctgttttaaaaccgtattgattttctctagtataagattcccgcatcaaacgacgcaaaacatcttcaattaaatccggtgaaacacctaacttttccgcttcattgcgacgagcctgtaacatttcattttcacgttcaggtacataaatcggtaatccatattgatgtttcactttgcctacttttctgactaattctaagcgttgagaaaaaagttgtagtaattcacgatctaagcaatcaatttctgttcttaaattttttaaaacgtccatagctattttcatcttactaatataggttgtacatttattattacaatagttgtaaaaaataacttacaaaataaacatcaaatacgcaactaaattttataaaaaaataccgcactttgcgttctgattaatccgcaatcgtttgcttgtataatttatattatgctattcttagcattatttttagtaaaggaattcttatgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgccggtggtgccgcacatttacccggtatgattgcagcaaaaactatcgtgcctgtattaggtgtaccagtaaaaagctcaatgttaaatggtgtagatagtttatattctattgtgcaaatgcccaaaggcattcctgtgggaaccttggctatcggatctgccggagctgcaaatgccgctctgttagcctcacaaattctcgctgctttcgatccgcacttagcacaaaaattgcaccaatttcgccaagctcaaactgacagtgttttgaataattccgatccgagagaataaggctttaatttttcattaggtaatgttgagcaatgaataaaaagccgatagttaaaaaatcctatcggctttatgacttggtcagaaaaattaggctttataatttttattcaaagcaaatgtatatcctctcaaacagttgtttaagactttccggtatccatccagctatccctagcataagtcatttggtttcccaagtcattttaattagttgtcttttggcactactaatagttcaatacctttttctctaattttttctctcatttctaaagacaaaccttcatccgtaataattgtatggattttatctaaaccacacacaatattcgggctttttcttccaaatttgctggaatcggctaaaaccacaatttttttcgctgcatcacacattagagaactcactttatagacctcattaaaagtagttagcccaacgtctaaatcaaagccatcagtaccgataaaaagtatatcaaaggttgaaccgataaaagcagattcagcaaaataaccgtgaaaagaggccgatttttcacgaaatgtcccgccggaaattaataaattataaggtttattcagtactaaaatagcattaaagattgttaaactatttgtcattaaagaaagattatcaaactgctttaagtatggaatcatttgtagcacagtactccctgcatcaaaaatgaccgaatttccttcactaataagcgttgctgctttttgcccaatacgttgcttttgttgaatattaattgctgttttttgtgcaatcggtttatcttctttgtcctctttattgattttttcttctcgttcaagaagttcttcatcaattaagacgacacttccataagtacgtaagacttttctatcttcttcaagtgcggttaaatccttacgaattgttgcacccgtcaatttaaaatgagtagccaaaacatctacttccgttcgcccatattttgctaaaaacgctaaaattagctgtcttctttcaaaaggtttcattgttcctccaatttagcaaaaattggagcgaaccaatctatgctaatatagttttagttttgtcatgacatctaaaagtgaagccattctttcatcggcaattgaaaatttttcattttcataattggaattcaccaaaaatgtagttaaattggctgctttggctgcaattaaaccagtaatactatcttcaataacaatacattcttgtttttcaatccctaatttttttactgctctcaaatagacggcaggatgtggtttgccatattcttcatccattgcgctacattgaattgggaagtaatcccacaaatttaagcgatcaaaaatggtcttaattacaactggaggcgatgatgtagcaactgccagtttaatatgattagattttaaaaacgctaataattcatacagccctttcaaggctatacctgtttgtgcaattgcattacagccattttccaaaattgcttcacttaatttttggttggatacggataagttaaattttttaatccaagtttcactcaattcatcgatccgtttacccctagtgaatttttcacactctttctcggtaattgcgataccaaattcagccaataccgcaatttgagcctttgcccattgaggttctgaatcaatcattaccccatccatatcaaagataacactattgatttgcatcctttttctccattatcgcatttttcaatgaaaaaatattcaaaatgaaataaaatttacattgttttttgatcttaacaactatatccggaagatattgctacttttaacgcaaattgtgagcgtttatcagttggaaaaattttttccggaataatttgatcaagaggtaagccaatgacgtcaactaacttttgtggtctggcaaaaacagaaaaacctttcatgtgaagactatccacaacttttttctcttcattaaatgccaagacaatcaccgattttggattaaaacgaccgctgttacgcccaacagtgatttttcctttcttgcttatttctagaaaagcttggttaaaggctctaatttgtagccagcctagaatagattgcaaaagccacattataattgagaatgtaatcagcaatgtaattggatccatttttacctcttaataaaaagccatagagtctgaataatctggctgtttactcatttagaacatcacttgaccgccagtaatattaattgactgtccagtgcaataagccgcttcttcgctggcatagaattttaaaacattcagtacatcttgataatcacaacctcgctttaaaggtactttatcaatataaacttgctccacttcactctccgagataccaagtttagccgcatattgtggaattaaagattggaacatcggcgatttcaataaattgcctaacattaatgaatgaactgtaatgcctttgtcagcaagatctaatgctaaggattgcgttaagccaacaccgccaaattttgccgcactataaccagaattgtacttacttccgactttacccgatttagagttaatttgaatgatacgccctttaatgccatcacgaatcattaaacgggaaaaatgcttggcagttaaaaagtaacccgttagattcacttttactgataaatcaaaatcatttaaattgaaatcccaaatgggtgaagcttttgcagtacctgcgttatagaccaagacatcagcacgaccaaatacacaatccgttacttttgtcaaagcttcaacgcttgattcatcgcccgcatcaacttgcaccccaattgcatttccttcgccttgcttgacgttaatatcagcagctactttttgtgcattttcgccatttaagtcggcaacaacaatacgatagccggcatccgctaaacctttagataaaaatgcccctagtgtttgaccaccaccgacaacgatggctacttttttttcattattcataatatattcctttaactttcaatttgaaatcatttctaatttggacttaatcacgtttaataactaagatggaactttccattaatgtttttggtggaacaccaacaacatgaacacttcccggaaattccgcttcggtcgccccatcaaaacggaaagtaatgtgtccgagtgcggataaattatccgacgctacactgccaatggcggtaatcggatattcaacaccatcaaattcggcaatatcgccaacttgtaaagcgtcgcttaattcagatggattgtgtaagaaacagtaatcttctaaatcggcaggtgcattttgtttgaaagtgattaacatattgtcgtttagtgcatcatgagcaaaattgccgattttagtaaacgttgttttatagataatcgtcatttgaatattccttttgttttacaagcggttggtttgcaaatttaaccgcttgtaaagtgattactgataaatgaatgcagataccgcccatgcaattaatactgtcggtgcaccagtcaaaaaacgactgactaatacagaaggtacgcccactcgcacagtatcttgtttcgcttctgccattgaaagccccacgggaatgaaatcacaagcggcttgagcattgatggcaaaaagtgccggcagggctaaatgtggtggaatgttccctaaaccgatttgtgtccctactaatacaccgataacttgagcaataacagcaccgggacctaagaatggagagagtagtgggaaagaacaaattaacgcaagagtaactaaaccgagtgagctatttgcaagtggtgttaaaccatgagcaattaaatcccccaaaccggaagcaataatgattccaatcaaggcggaaacgaatgccataaacggtaaaatggttttcaggactgtatcaatagtatcacgtccggcttggaaaaagagtgcggcgacagaacccattcccatacctatttttgccaataaaccattactttgttcggtgatttttttacttgaatcatactcttttgcggtagttgatgaagcaattttttcttcagatatgacagaaagggctgcggcatccacatcaattaacgaaatattattttcttttacggcagaaacataaatatcttcaacaataaattctgctaaaggtcctgatttgccggttgcgtgaatattaatagttggaatgcgacgttttgggtaaagcccacaacgtaatacaccaccacagtcaacaattgcaattccaatttcttctgctggcggttcgccttctttaaaaccatctactgcttcccagccagttaattccaccaatttattcacaatagcaggacgagtgcctccggtcatataaagtatttttttgccttcaataataggtaatgttaatggaccaccccagccaccgttacctttttcaatataaactgctttattactcataatgtattcctctacttttcattccgtttaattagtttagtgagatagattcacttctctatctaatgtaattcccattcttttttcaaagaaagctgtggtaaagtccgtaatccaaccacggaagaagttagtgaacatgccgactaataaatagctaacagctaaaggtccaagaggtaatcctaaagtcgttaaaccactggcaatacctaaataaacgaataattcacctgggttgatatgaggaaataagccgttcattgagtggcagctataagatgctgcggcgtagtaacttggtttataacgctctggtaagaagcgtcctaaacttaacgtcataggattgcaaaaaacgaaagtgccaattaccggtaagatcaaataacgtgaaataggattgcctgcacttttctgtgccagtctttctatacgatcttgcccaataaatttaattaaggcattcattacaaccagtaatgagattaatagaggtaaaataccattcatcattccgactaaggtttctccccctttttggaacaaaccgataaaccattctgctccgtgtgtgattgcttcgatcatacgacctccaattttcaaaataaaacatattttttcatctctgcattttagagacatgtaaatagtaagttattttcattttaaaaactgtgaagttgatcaaaaaatcaaaatttatttcaaaataaattattattgtttcggtttgaaatattgattgagtaatttggacggaaagaggcaccttttgttttaaacacataagaatttaagttaagtaaatgcgaaaaattaagcctttttcatcaagcaattgatgatttattcgtcgcagagacgaataaaagtacactggttttaagtaatggtttggaaatggaaaagggcgataaacccaaaccacctcattatcatcatgtcgtgcatgataaaatgatgcaccaagcagtcaaacaacatttttagttagaaaaacaatgactcacacacgatggagggcggattaaatcagcaactcttttttattgatgatattcaaggttatcgtgctgagaaaaaatcagttttcaggcaatctgaaaatactttttgaataaatggtcatagttgaattggaaaatatcctaaaaattaaagtgatgaatttttcaggatatttttattttaaacttgacatttaaaaaatgtcatgataataaaacgtaaaaagtttattatggtaagaagggaatgaagaaaaaatatataactgcaattctgttattaatatcagcatatgcttattcatataggattaatgttatagatgattatgatttaattgataaggaatatatagaattttggaatagagatgaacttataaaacagatagaagtattaacaatagaattattaaacagaggttatgtaacatcgaaaattattgataaagaagagaatttagttattattcctggaaaaatacaaaaagtaatattacaagataattcgacaaaaaatgcaaaattaaaaaaggaattattaaatttaaataaattagagggagagatattaaatattcgtgatattgatgaaatagtatctaaatttaaaaaaataaaagataataatgtaaaaataagggtggaaaatatcaaaggtagtcaagatagtaatataataatcataaatgactttaaacctgcgatatatcctaaaatttctgcagattattctaaaggtattaattcggattcttatcgtggttttaaatatgttgttggatttggtttcgaacaattaataggtatgaatgacgaattaaatgtgaacttttctctattatcagattatagaaatatgagcttgaaatataaaatacctataagaaataatgaagcaacaatacagtatcagtatacgaaagacattttaaatgaagatgtagaaacaatagaaagagaaatattattgaatgtaaatacggatattaataatatagatttaaataattcgataactataaataataaaaggtttaatgtaaggaaaaatacgaatataacaaacaattggttttatgagtttgaaacaagtttagtgtatacaaaattattgaatttaagtggttattatgttcaattaatgttaaaacctaaaataggtataaatattgcggatataagagcatataaaaaaaaggattatgtaattacatcaggtatagattttaatttatattctaaatactatgatttaataacgaatgtgatttataataagaatatgagttcggatagtgtgtatgatcgttatacgagaaaacttaatatatatgggattgataatatcccgttatcaatagcaaagacagataaactcatagttatgaataataaactgaaatatccaatgacaataaacaaaattaatgtaataccatatatcgatgtggcactaggtagtaattttaaagaatattcaactggaatgagcataggttcaaaatttaaatataaacaaacaagtattaatctagaatactcaaggagtaataaaggtaattcagttttaaatttaaatttagggtttgaattttagtgaaaggaaatcttagtgaaaaggagttgttatgtataatgagaaaaaagtattaacaatggtatatttatttgcagtgatatccgctcaagtaaatgcacagaccgtgaaaaatggggacacggaggtagaaaagaaggatggtttcgatataatcaatattaacacgccaaacacaaagggagtttctgttaataacttaaatgaatttaatgttaaagataaagggacagttatcaataacattgagtctactcataaatataagacagttcattttggtgaaatcgatggaaataaaaatataaagactaaagaagcagatatagcagtgttgaatgtgaaggggacgagtaatacaagcttaaattcaactttagaagctgcatcatcaaatccactaaaagtatacatagctaatgaaaatggtataaatgttgatggtggtaaatttgtaaatatcgacaaattggtactgactacaggtgttgttgatgacaatgatatgtcagtgtcggttaaaaaaggtgatgttaatgtttcatcaaaaggaattagcggcgttaaggatatatcgatatatagtgaaaaattagataataaaggtaaaattgctgcagaaaacacaaaaatagtactaggacatagttctataaaaaataatgaaatatcttcattagatgataattatgtgagtgcgagtgatttgggggctatttatgggaatgatatacaaattcagtcgacggggtatacggatattaatgttaacgaattattagcaaaaaataatattaatattaattcaaaaggtaaaattaaaaacaatggagatattatatctggaaataaaatagatataactgctaaatcgcttgaaaataaggggactgtagattttggtaataatacacatgaattaaaatggatagatgctaaaggtaatgtctacactaaagaacaattagaaaaagtgtggaataaaagaatgaaacaaactttaacaccagaatatgcatttctttatttgacgggttctttattaaatcaatgggctactgatgaagaaatggcaaaaaggttaagcccagaggctaatatttttaaaagatttgatgaaactttaaataaatttaatgataaagatataaatacttttttaattagaaaagataaagaaaaagttaaaaataaacataaacaaagagattttgttaataaaggagatatttatgcaactgagatagatgataaaaaaatattagaagcagttgcagtaagtaatgttaaagccaatcaatctattatttcttcaaaaaacattaaaattaatttgactgatgatttattaaatcaagatgctagtatagaagctattgatgaattagatattaaagctaaagctaaaaaattagttaataaaaatagtttatcaaatgatataacattgaatgatggatatgaaaatttatcttgggatttaatggttttacaaaaagatataagagccaattatgatataatttatgaaaaaggcttggtttctgatcaggcagcaagaaaggctaaaatagctgctgtgaataaatcacaaattaaggctaaaaatatgaaattagatgtagataatatagaacttcacgatgatataaatacaggagcatctattaaagcagataaattagaaacaaattctaaaaaaataagtttaaaaggtcaaagtatagaagctaaagaatataatatgaaaactgatgagcttgttttgaataattcaactatttatacagataatatagatattggtgctaaaaatgttaaacttttaagtaaaaaagataaggaaatagtaataaaaacaggtaaagaaaatttaacaaaagaaattatttctagttcaggtatttatgctaagaataatttaaaaattaaatcaaaagaattgcaatcaaaaggttcaattattaaatctgataataaagtagaaattaatgttgaattactagaaaatcttgctgaaaaagttacaaaagattataaatcatcttatgatatttctaaaacatttagaaaaattaaacataacgaaaaaagtgaaagagcggtagctagttttatttatgcaaaagatttagttttaaattctaaaaaaacaaataatgtagggagttatattgtaggtaccgattcaataaactataaatcgggtacaactaagatagatgccttaaagattaataatgaattagacaaaaattatggtgtagataatggtatattaggtataaactataataaagttaagaagatggaagatgaagcagttgggtctatagttttaagtaaaggtgaaataaaagctaagattgataaagagctagaaataattggaagtagccttaaaggtaaaaaaatctttatagaagctagtgatgttaaaataacttctaaagaacttgacaaaacaacagaaactgaatcaagacaattacttgctggggatttaaaaggtggttttgaaaagaatgctactttagataatatatcagcaaaagtagatatggaattatataaaaatgaaaaaatgatagttaaagaaaaaaaacattcaaaatcagaaattgaaggagaaaaagttacaatagtagctaaaaatgaaaattcaataaaaggttctcaaattaatgctaataatttagaacttaaaggaaaaatagttagaatagaagatgatatttctaaaactgaggttgagaagaatacagtaacggtttcagcgactaataaaattgcagtaaatgaaggaaatttagaaagtgataataaattaataattagtaaaactaaagaaaatttaaatactgaaacttctaattcctcaaatattaatgctaaagctaatgtgaaaatagaagcagacaaagtgttagtgaaaggttctaaaattgaaggacaagaagtagaaataaaatctaaagaaaaagttgatatagttaaatctcaaaccaaagaagattataaaaaggattctgaaacagttacattagggtctaatgttaaattagatgctaaatctgttgcaattattcaaaccttaaagaaaatgtatgatgaaaaagacaatctttcaggatatgctttaaatccagtgtcaggatatcaaaagataaaagaatataaggtaatgctggaaaaaaatattgataacattaaagaattagttgctaatgtttcagataaaaaactagatcctgaatctttaggggtaacgatgaatgttgaaaatagtattaaatacaatactaatcatttaacatcttcaaaatttgataataatgaaagtgaaattaaagctgataaagttacaattaaaacagaagagttatcattagaagcatctaagattaaaggaaatgaagttaaaatagaagctgaaaaagtgagtttagaatctgctgagaaaaaagtaaattcaaacgaaacagatgccagtgttcaagtagctatggtacatgaaattataagtcaaaatacattatttaaaggtgattcaactgttcaaaacaaaggaaattataaaacagaacatacttcaagtaaaatagaagcagaaaaaatagatttaaaagctaaagaattaaaattacaaaattctcaaatagaaacaaaagagggtaaagttgaaactgataaattaagtgtatatgataaggcagataaagaaactaaatatggcgttactctagcaggtatgtataatggaggtacaaaaattggggttgggagtgctacagctaaagtagagcatgatcaaaaagttaaaaatgtatctattgtaaaagttgaaaatggtaaagttgatgttaaaaaagaagataaaaagaaagatatagaagtcaatattgatgttaatactcaattgggattaaatgtagatccaagcggtgatgttaagggtaaagcaagtggtggagcaaaaactaagctagattcaaaaggtaaaaaaattcaaggtacaggttatgtaggtgttattggagatttagcttttgaagatggaaaaatcacagatgtaaatgtgagtactgagcttaaaggagatttgacaattacaccagaaaaatatgttgatgaaataaaattaaaagttaataatcgtttatctatagatcatgatggtcaaataagtaatgatttaactggtaatttatctactgttactcaaattaatactgaaaatatcaaaagcaaattaaatgtaggtgtagacggtaatctagttactaaaaatatggatataattcaaggtggaataaaaggaaatgctgctggagaaatagaagcaatagtaaaaataaatgataccgtcgaatctaaattaagattgatggctgaaggtaatgtaattaaggaacatggaaaatacataaaactagattctgaattatcgtcaaatgctaatttgaatgtaaaaggtgcaactaaaaatgtttccggctacattaatttagctaataattcgagcataaaaattaataacgaaaatggcattaaagattattcaatagataataatgttgatggtaatctaaagtctaaaggaagtataggcgaaaatgtttcaggagacatagacataaatttaaaatcggatttatcgaaaaaaatgtctcaaaatataacaactagtaccgctgttatggggaacggaaatctaaaagttgaaggaaaactagaaaatttagatggaaatatgggattaaatctaaatggaaacgtggcaggaaatgaggcaggattacaagagttaacaggaaatgctaaagctgatggaaaattacatgctcatggagtattggaagcgtttagtggggatgtaacattagctggaaatactgaattaaatgcaaaagtaaatgaagcattgaaattaaagggaaatttaagtggtcattctaatattagtgttgagggacagacagatgtagtaggtggcaaaattcaattaaaacctcaagttaatatatcgggagataatgttaataaattaacaacatttgatacgagtactaatttgaatggatacattgaatcgaaagtgaaaaatgagtatgtaagaaacattaaagcgaacctaaatactatattcaaaactaaaaagtttgaggtggagacttttgaatcaagtcttgatagtgaagttagatctaaatataaggatatagaatttaatttagcttcaggagaaagaatatcattaaaagactatattcaacaaaaaatatctaatgataaataaaagtttaaagaaaagaaaatttttaaaacaaattttgatctgacactaaaaagttgaactgctattcaaaggactgattttgatattgtatcggactcagtccttttaattgaatccgttcttcgttgtaatttaatcagttggttatttaatcctcctttcggaggcttgatcaaagagtagttttctgttttataaaattttgggtagtgaataatactcaacgtcatatcaacctaatatcaaaacaacatactgaataaacaaattaaaaggatattcctagtgcttgtttcattatttgttctttgacgaaaccgaatcggttagtggtatttaaacctataccacgtactaactttttcactggattatcgccgttaaagagttcttttagtccctgcattgccactaacattttgactgccgctgttttctgacagcgttcataatgacgcaaatatcggtattcaccaatatccattcttaaagctaaatttttgttaatttcttgtgcaagtataacggcatcttgaaaacctaagttgactccaagtccggctaaggggtgaatagtatgagccgcatctcctactaacacaatgcgatgtttggcaaaactacgtgcataacgtgcagttaatggtataactttgcgttctccacgcacctcgcataatcctaaacgattgtcaaaagctacagataagtttttattaaattcattttcctctgcgtttaagagttcattggcttgttgtggcggtaaagaccaaactattgagcataaattttgttgatgtaaaggcaagaaagctaagatgctgtctttgttaaaaatttgtctagcacaattcttatgcgattcagaagtttttacgttgcaaactaaagcatgatgtccataatcacgaaaaatgagcggaatatctgcttgtttacgcacccaagaatttgctccgtcagcccctacaattaattttgccgataacatctgtccatcatttgtggttaaaattgcattgttttcggtgagtcctaaatgatgcggaagtgcggtaataatttccacatttttttgcatttttaccttttgccaaagttgattttgaatcagatgattttcaataatatgccctaaatgctccagccctaaactttgtgtatcaaattgaatttgtgcaaaactatctttctcccaaacatccattttgtcgtatgccgtcgctctcaaattcaataaagcttgccaaacttccaagttttgcaacattttttcgctggctaaatttattgcactcacacgattactaagttgctcaatcggttctttattaggaaatccttcaattacagcaattttcatagggctatttcgcaagctggcagctaaagccaagcccaccatgcctccaccaataattgcaatatcaaatattttcatcgtcattactccaaataaagataagtttaacaccagcctaacgttgctttagcaaaatactgtcgcaataaagaagattgagcaaatgccatcaagccaaaattacgcccaatttgtagcggtaataaattattggcaaaaatagagactaaaccatcagttaaaccaataatattacgttgatcggggttgcgttgtttcgcatagttttgtaaaacttgatatttcccccaatcttgttgttgtaaataagcttgcgataccacatttgccaaactcattacatcacgaatacctaaattaaatccttgcccggcgaccggatgtaaagtttgacaggcattaccaactaaggcaacacgatcttgaatatgttgtgccgccttatataaatttagagggtaggcaaaacgtttaccacattctttcagttttcccactcgccaaccaaaacgttgttgtaagcggtttaaaaattgctgatcatcaaggtttattatttcttgactatttttgacgcaccaaaccaaagacattaaattgtctttcattggcaataaagcgattggtccttcttcggtaaaacgttcaaaggcacggttttggtgaggttgttgtatcaaaatattactgataatagcagtttgttgatattcacgcacaagctcttgtgtaatacccaccgcacttgctacgttggattgagtaccgtcagctcccaccaataaatgagtgcttaaagtgcggtgatcttctaactgaatgtttacttgctcaacatttcgttcaagagaagaaatagaaacgggggaaaaataatctatattgctacaatcctgcatagctcgcatcattaccgctcccgcctgatttaattcaatgacagcgcccagagccgcaagacaaaattctttagcagaaaactctgcaataccgaaatgccctcggtctgacacatgaatatgtttgataggttcacaaagaggcgttaataattgccacagcgattgcttattcggcaataaaatctgattgaaacgccggcaacttcctgatgataaagcaatacagcgagcatcaaagccaccgtgatgatgctgatgaggaatttgtttttccagtacggctatttttattttaccctgtgtttgatagctgagtgccaatgctaaactcgcaccggtcataccaccaccgacaattacaacatcgtagtgcaagtgcatatttttacccctctttcttcacttaaattattgttgcatcagattttcaatatcctcaatttcttttggtacagcagaggttaaaattttattcccattttcagtaatcaaaatattgtcttcaatgcgaacgccaattcctttatattgttccggtacatttgcctccgtaccgatatataaaccgggttcaacagtcaacaccatgcccgcttctaaagtgcggtctcgttttttactatttcgatctccgttttgcacctcactactgtagcttcctacatcatgcacatcaagtcccaaccaatgccctaatccgtgcatataaaattgacgataactttggttatcaattaaggtttgtacatcgccagctaaaattcccaaacgaactaaaccctccactttaattcttaccacttcatcatttgcctgttgaatactattgcctgccactaataactcaatagcacgtttttgtgcttttaatacaatttcataaatttctcgttgtgcctgagtaaatttaccgttgacaggaaaagtacgagtaatatcgcctgcatacatagcaaattcacaacctgcgtcaataagcaacaaatcaccatcttttaaaatttgatcattttcgttgtaatgtaaaatacaagcgttttcgccaccggctacgatactgttatacgcaacatatctagcaccgaaacgattgaagtgatgtagtatttcactttcgatttcatattcaaagcgattagggcgggtttgttgcattgcgtgaatatgtgccaaagcagaaatttgtcctgcttgttgtaacaaagcaatttcatttgctgatttaaacaaacgcatttcgtccacaagaactgcccaatctaaaacttgtgcaaattgcacagtttttttattcagtatatcttgtaaaaactcagttccccaaggttgttgagctgaatggtaataaagtgcggtgatattttccctcagttgtaaaaactgtgtttcaaattcggcaatgtcataagccaaatccacagacaacgttttcggtgcattttcaatccccaaacgtcttccgttccacgtttccattaagggatctttgggccgcaaaaataaaatactttgtgatttttctgcagttttgattaaaagtaaaatgctatcaggctcattaaagcctgttaaataccaaaaatagctgtcttgtcgaaaaggataatgacaatcctgattacggattttttcctgagaggaaaaaacgatggtaattgaattatcttttaattgtgctaatagtttcttacgacgaaaaacaaactcatcgttaggcatttttgccatataagcaagatccataaatactccttaatgcttaaaaaacacactgaattctagcataaaaaaacaagtcattcgattgattaaaaaacaaagctaatctatctataaacagcaggcaataagaaaacaacgcactttattaattgagcgagtttagctaaatacattgactaatgtaatacggttttctttgtttccgataatggtccgaagtgattaaagaataaaaaggtaatcgttctcacatattcaataatttcttctaatgctttagacaactcctcttgatcatctttttcatcatatccaagttgtccaatagcttgtaaatcatccagtgcttcgccgatttcgcctacctctttatttaaattaggctgatttagccctaatcctaataaaaaatggttggtccattccgacagagcatcagctcgagcaaaaacattgtcttcttccggtaaccaaagctcaaaattaaatttatcaatatcggataaagtgcggtcaattttctgataaatttgttccacttctttcaataaggaagtgggatacgcatgatcatcatttgtaaattgataaagaagatactgccaacgttgatctgtaataccaccgcaaattaaaccggtaagaaaaccatgcaattcagccaccgttaatgcaatatttgcttgtttcagttgttgattaaattccgaataaataagaggtttttctgacatttgatatttccttgaaaaataatataccagtttatcactgtttaacttcagcaaccaagaaacaaagggatttttatgacgaaaattttttgctatggcataataaggacacttttagcttttattataaaataggaaaacacatgtcaaagctcattgaattatccgtatcagggcaagtactacgtttaaattgtcctccagaacaacacgatgctttgcgtcaagcggcacatttattagataatcgtgttatggaaatgagagagcgtaccggtattttacagatggaaaaaatcctctctattgttgcattaaatttaagttttgaactgatgcaggaacaacaaaaaactcaaacaatcgaaaatgtcattaatcaaaagattgctcaactcgaaggatctttggagaatattttggctcaaaaaacaactttttaaacataaatctgtgatctaatcgtgataatttgaaaaatattctagccaataaaaataaattgcgttagtattgcactcaaagattacctgagatgtttgccagcggattaagtccctgagccgatactgaaaacttaatgaattggcgtcctgttgttggtgtgtatgcttgctagccatgcaagaaacctaaaaacaatattagccgattcccttgaaccgtagggttcaaggaccgaacatccgcagcggcatctcggggctattcttagttatccagccaatatattgtcccatgagtatttctaatcaacgtcagcaaatacgacaacttattcgagaaaaaagacaaaaactgaccgcacttgagcaagctcaagccgaacaaaatattgcacaaaaagccttggatgcgattgaaaagtttcgtgcggaacatattgccttgtatctttcttttgatggtgaaatttcaacgaaattactcattgaacaactttggcaacaagaaaaaaaagtttatttgcctgttttacacccattttctcccggaaatttattattcttagctttccaaaaagatacacctatgcactacaataaattcggtattttagaacctaagttgaatgtgcgaaatgtactgcctgtttcacatttagatttgatttttacgcctttagttgcttttgataaggatggaaacagattaggaatggggggaggattttatgatagaaccctacaaaattggcaaaaaaaatcttttgtccctatcggattagctcatcaaattcaagaagtagaacgactccccattgaaagttgggatattcctttagcagagattttaaccggataatgaacgcttaaaacgtttacggcggcgatgaaaattcgccgaagcggtacttttttttattgtatgagtaataggcatcatatcaggcgttttttgtcttgtgcgacgatggtaattcaaaaaataatgaatggaattcaccaataaagcactagctaaaaatagaatgattaattcaccatataactgattaaaaatgtggtttattttacgctgacttgcttgtctatatttcatatcaagagtaatacgtaaaaaaccctcaataccattagatgaataaatcggttcaacaatttgctgaatattcggttgcgtagtattgttcgctttttgatttaagttcaatttatcacgcaaaccgacaaaattcgcactatgtgctaacaatttaccgttagcaccataaacagaagcatcaatcacaaattcttctttcgtaaagtcgttcagttttttggtcaaaaggtccgaattggggttatccgcaaaaagcatggcaaaaagattagcttgctgacgcactaataaattggataagtagttcatttgattaattgttgctaattgtgaccctaatttaaacttattaatcccaaataaaatcaaagacataatagttagacaaagcaaaataatgccgagcaacattccaatttttagtattttttcttttattaagctcaagttattttccctaaaaattattaaataggctagaataagaacaaagaaataatttacaggatcttttatgcaaactcaaaacctagagacaattatctctcattatacgctattcccttccccaattttatcagaaaaacccactgtacttggagaagattacttcattctctatggtaaaaatttaaatttggacagtttattaacttttcaacaaaagtgcggtgaaaattttctgattttagattgttggaatcggttagattacactgttgccttattcaaaagcaattggcaatcgcagtacttaactgttgctcatcaactggaacttgatattgcattattaaattttgatgctcgtttaagtcaagcgggattattagttatggatatggattcgacaattattcaaatggaatgtattgatgaaatagccaaccttgccggtacaggaaaattagtaacctccattactgaacaggctatgcgtggagaacttgattttgaacaaagtttacgtcgtcgagtagaaacgcttcaaggagcacctgaacatattttacagcaagttcgtgatagtttacctttgatgtgcggtttaaccgagatgttggaagtgttacaaaaatatggttggaaaattgccattgcatcaggtggatttacttattttgccgatcatttaaaagaaaaattaaagctggattatgcggtttccaatcacttagcggttgagcatggttttctcactggaaaagtacaaggtgatattgttgatggagcatataaagcggaaacgttaaaatctttagctcaaaaatggaatatagatttaaaaaatacagtagcaattggtgatggtgcaaatgatttagccatgatgaaagtcgcaaatctaggttgtgcttttcatgccaagccaaaagttcaacaacaagcacaagttgtggtaaactttgccgacttaaccgcacttttatgtattttaagtgcaaatgatcggattacaaaaaattaaaattgaggagcatattatgccgtcatttgatattgtttcagaaattactctatatgaaatacgcaatgcagtagaaaatgcaaatcgtgtattaagtacacgttatgattttcgtggtgttgaagctacaattgagttaaatgaaaaagcagaaaccattaaagttacgactgaatcagatttccagttagagcaattaattgaaattctaatcagtgcctgtgttaaacgtgatattcaacataattccttggatattccggctgatagcgagcatagcggtaaattgtatagcaaagaaattaagctaaaacagggtatcgaaacagacatggcaaagaaaatcatcaaattaatcaaagacgcaaaactaaaagttcaaacccaaattcaaggtgagcaagttcgtgtttcaggaaaatcaagagatgatctacaagcgactattcaattagtaaaaaatgcggaattaggtcaaccgttccaatttaacaatttcagagattaatttttatttttcctacagaaaccgccaacaatataattgcacatattattggcgtttttttgtattcaaattattacagtattcttaaacttcaatactagtgtaatttaaagctaataggtactgtaatttggcttggtagcccagcaggtttttgcccaatactgcgtgcactttgaaccgcacttaatgctgccttatccaaatcttctgaacctgaagattttgcaatacttatttgacttaagctcccatcagcaccaatagcaaaactaacagtaacaatcccttgttttcgcatcatttttgcacgttgtggataacgtttatggcgttcaatttcacgacgcaacgcacttttataagcagcaacttcatcagtactatttcctgttccaatcaaattcggattagatgttgttactccacccaagcccatagcctgcgaatttactttatcgtcagaatcaatatctctatcacctttaggtaaatcttttggctgtttttgttttgtacgttccttaggtttcttcttcggtttttccttcggcttatctttgggtttctccggttcttttaattttttctccggctcaggtttaattgttggatctgcaactacctctgttactacaggatccggttcaggctcagctaccggttctggcttagaatcatctacaaccatacccattaacatttccattgagatctcagtaccaatcaaatccgcactatatccatttgcactgtcatctggtttagtaaaccaaaaaaaaccgccaattaatgcactatgaaatacaagcgagaagaaaaaaccaaaccaagaatgatatttcttcattacttacttgccttttctttcatcgttacaatagcaacatttttaatttcgttttttgccataatatctgtcaaggttacgaaatcttggaaagtagatttagcatcgacttttaatgtcactttttgctctttatcccaagtcgcaatttcttgctccagttcttctactgaaatgggcttatcattaaaaaaaatctccccttgctcagttactgtcaataattttgctagatcatcggacttgaaagcaactgtgctacttgctttgggtacattaacttgaattttcccttgagaaataaaagaagctgtaattaacacgatggcaagaagcaccaacataatgtcaataaagggaataatattaatttcatcaaattttttcacattactcaccaatattttgctgactgtttaaggctttccattttagacggttaacttcaactttacgtcctaaaccgttgtaaaataccatagaaggaatcgcaacgagaataccgactgcggttgcttttaaggcaagagataagttaagcatgatagcagctgcatcaatgtctcctcctgagttacctaattcatagaacgttaataaaattccaattaccgtacctaataaaccgacataaggtgcattagaaccaattgttgagataatggtcaaatgacggtttaaatcaatatccaactcatgaatattcgtgtaactttccactttaattttggtcagatacataaaacgttcaacggaaaaccataacataataaaactcattacaccgagtaaacccaaaatgatgtagtcaatataatgatgtaaaaaattgaaaaactgtgacattggataacattccttgctgataaaaattacaaataagttattgagaattaatttcaattagggtgaggattttaacaaattttattgagagatcaagctataatattaaaaagagactttttgagtaccgcacttttccatctgttttttattttagtgaaatttgacgtttttcgttcatactatgataaagcaattagaagaaatgtctaattaaaatactgaaagataagacactagtaattgacatccccctgccttaaggccgggcggatgtcaatttctcaaaaattggctgatgactaattctacgcaccatgcgatgatttcattattctctgccatttgtattgctttttctagtttttcaaaggcttttcgaaatgagagaatctatttaaatctttttttcgcttcagctatcgcttcagctacacgtagtggtgaaactccgccttttgcacaacgtttatccaaacaggattgtaaagataagatttcataaacatcctcctctatggtattactaaattgatggaattcctcaatacttaaatcttctaaacctttatgtactttaatagcataaactactgtttcacccacaatatgatgagaatcacggaaaggtacacctttggcaactaaatagtctgctaattctgttgagttagaatatccctttaatgccgcttcttttgttctttcaacgctaactttaatatcttctaacacaaaagtcgccatatctacacaatcttgccaagtatccaacgcatcaaaaattccttctttgtcttcttgcatatctttattataggcaagaggcaggcctttcactgtcatcaacataccggtcaaagcaccgacaactcttcccactttgcctcgaattaattcacaagcatcgggatttttcttttggggcattaatgaagaaccggaggttactcgatccgacagctccacaaaatcagcctctccactattaaaaatgatcatatcttcagcgaaacgtgaaagatgagccatacttaaagacgcagtggaaagaagttcaataatatgatcacgatcagatacactatccaaactatttctcgttgccatcgcaaaatccagatcttgtgcaagtaaatcacgatcaatggcatacgcagtaccggctaaagcaccactccccaaaggacaagtattcattcgttgataagcgtcttgtaaacgaccataatcacgatccaacatttccacataagccatacaccaatgagcaaatgtgattggttgagcacgttgcaaatgagtataccccggcattactacgtgttgattatgctctgctgtttccactaatttacgttgcaattcacgcacggaatactgtaattcagtaacacgttgtttacaccacatcttaatatctaatgcaacttgatcattacggctacgcccagtatgtagttttttgcctaagttacctactttatcaatcagtttactttcaacccaactatgaatgtcttcagcatcatcttgtaaaatcttttgtggatttgaccgcacttcaattagtagttcactcaatgcgttttcaagaacttgctgctcttgctgagttaaaacatttacggtaaccaatgctttagaccaaccgattgatccctcaatatcttgttcagctaaacgatagtcgaaacgcaatgagtcgttaaaatctttaaaacgtttatctgtcgcttgtgtaaaacgcccaccccaaagtgccataatcacatcctttttctgttattatttgtggataaatttagttctcattatctcacacaaagaaaagtgcggtcaatttaaccttcacaatcccttcttaatattaccgctgactgtcatattgatactaaacgactccactttttgacttgatttccgcttgtgttttctcatcgccatccagtacgacatttttctgcttattcggttaaagttaagagttttgatttaaattatgcgttacattatttaaaattactggaatgtatcatcacatttagatgtttgattcaagcaagaggaccttaatgtaatttatttagatcaatagtgcggtagaatttaagatattatttaataataaagggtgataggtttatcatgaaaaatttccgttggtatttaagttatagggcgggaagatttaaacattattggagaaatgtgcagtgtcaaatttatgtagaatcataaaggttttttttaaagtttttttgtatcgctttaaacaaaataaattaaatcaagcagcaggctatttaacttatagtactacgctggctcttgtgccattgattatggtgtttttttccgtttttgcggcgtttcccgtttttaatgaaataaccggcgagctgaaacaatttatttttactaattttgccccttcaaccggtgatgccgttggagaatatattgatcaatttgtcaataattccaaacaaatgagtgcggttggaattattagtttaattgttgttgctttaatgcttattcattctatcgaccgcactttaaactcaatttggcttgatactagtgtgcgtccggcaatattttcctttgcaatttattggctaattttgacgcttggtccgattgttattgcgacgagtatcggtattagtacttatgtgactaaatttgcaacctatacatttgaacaagatttgggtttatccgtgggtataaaacttcttagtttgatgccgtttttcttgacatggtttatttttaccgtgttgtatatggtagttccaaacaaaaaagtgagtattatacattctgccgccggtgcattaattgcagcagttttctttacattgggtaagcaggcttttacttggtatattacaacttttccgtcttatcagttaatttatggagcaatggcaacgttgccaattatgttactttggattcaactcagttggacagcagttttattgggagctcaactttccgcagtactggcggatatacgttcatttgattgtggtaatattcaaatagaaaaaattaaggaagaaaaatgattgcattaattcaacgtgttagccatgctaaagtggaagtcggacaaaatattgttgggcaaattggacagggattgttggttttactaggtgttgaaaaagacgatgatcgaagtaaagcggataagttggctgaaaaggtgttaaattatcgcattttcaccgatgaaaacggcaagatgaacttaaatttacagcaaatcggtggagaaatattaattgtttcgcaatttacgcttgctgcagatacgcaaaaaggattgagaccgagtttttccaaaggtgctgatcctgagttggctgagaaactttaccaatatttcagtcaaaagtgtgcggagaaagtgcgggtcgcaaacggacaatttgcagccgacatgcaagtgagtttaactaatgatggacctgtaactttttggttaaatgtataatataaaaataccgagtgttatgctcggtatttttatttctatttgaattaaaggaatttttcttttaattcttttgcgacagcaagttgtttttcagtcgcttttgctgtcataggttcacggcagtaacctgcattaacaccttgaagtttaaggatttctttaatagttaaatataaaccgttagccagtataccttcgattaagtcatttgtaacatgttgaatctcaagtgcttcagcaacttttcccgcttttgccaattcaaatatttgtcttgcacgtaaaccatttacattaaatgtactaccaattgcaccatcaacacctaaagagactgctggcaacatcatttcatcaaatcctgcccaaactagatggtttggataggcttttttcaagcgttccaataggtagaaatcaccggcagtaaatttaactcctaatactttgggattggcatagagttcaccgaattgctcaacgcccatattgacacctgttaagaatggaattgagtaaacgatcatattgttgccggtttcagcaataatcgtttcgtaataatgtttgatttcggcaaagctgaatttgtagtagaacggcgtgacggcggataagctgtcgtagcctaattctgttgcatatttacctaactcaacagcctcgtgtaagtttacactaccgacttgagcgattaatgcaacttgatcttttgcttcctctttggcaatacggaaaatttcttttttttctgcagttgagagcataaagttttcgccggtactgcctcctacatataaaccgtcaattttcattttatcaatgttataacgaacgatctcacgtaaacctttttcatttatggaaccgtcttcgttaaaagacactaataatgcactaaaaataccttttaagtttttcatttgtttctcctgatataaaagggattaaatttttatttaatacgttgttctaaaatcacattaactgttttttgtttagtttgtaccgcactttcttcttccgcttgaacaatcaaggtgtaaattaagtccaatacaaaaagttgagctatttttgtaccgatagaatcgccttgtagctgcccttgtcgattaccgttgattaatacataatcagaaaccatagtgataggggagcgtaaattatgtgtaagagcgacggtaacagcaccgtttttcttggcaatattcaatgcttgaacggtttctttggaatagcctgaatgacttataccgataacaatatcacttgagttcattaatgcggcttgcatatacataaaatgattattgcttgttgcatcaacgtgtaatccaatacgcattaatttattttttgcttcttctgcagttaagcctgatgaaccgacaccaaacaggaagattcgttttgatacacgcattaattcaacaactttttcgagttgagcaaaatccagcaaattaacggtttctgaaatgacattatgaatgacattttgcaatttttctgcgatttggcttgttccatcaaattttgatatatccgtttccagtagagaattagattgtcgatcttttgtagccaactcaatcgaaagttgtaatttgaaatcagtaaagcctttaaaacctaatgttcggcaaaaacgaataaaggttgcttctccgacatcgaattgttgtgcaatttccgctaaagagttttgtcccaacaactctggagaagatagaaccgttgtggcaatccgtttctctgtttttgttaggctatcatacaaagcaccaatggtatccaatatattaccgctcgttgccgccataattgagcctcttgttaatgttgtttgtttcttgatcaattagtgatacaggtattttaacgactaatttttttaactcagtagcttgaccatcaacattacagcaaggtttgtgcggttcgtaagggaaaaaaacggcaaacatttttgggcgtaatgttaccgcacttttatgcggaatatcatcaattaactgataatcgtcttgctcattataagcggtacagtctgctaaattcggatattcaacaccatattcaattgtttccgcaccggaaattaatacttgaatatcaatatattgatgatgcaattctgcttttttatcttcagaagccacagtcgttgactccatgacattcatataaatttgatcggttaaatcatgtcgacctgtgctcaaattttctaaatctaatgtattaagacgattgcaaatatcgaccattacttgtggtaagttacgcttaaaatcatctcttgttaaatcaccaaaaatcattttttactcctattattatggggtttgttgcattttcatccaataagccgcaccaattaaacctgcatcggcaccgtatttagccggctccaaaatacagtgataaaattttggcatgtcggttaaatattcttgaacgagggataagtatccctcagctaatccaacgctaccgcctaaaacaaccttttgtacatctaaactaatcaccatatcagcaattaagttagcaatagcttttgctgaggatcgaacaagtgcggttgctttttcatcatttttacggtacaagttgaacacttctttcggattacaaggtttttcccacttattcgcctcacgttcaattgctcgccccgccgcaattgcttcaacacaaccacgacgaccgcaaccacaaattggaccgttcggatctgccaaagtatgcccgatatgaccagctataccatttagcccagtggataattttccatcaagaataattcctccgccaacgccagttgataccgtgataaaaataaaatttcgtaccgcactttggtcttgatcttggtactctgcacaaacagcagcctgtacatcatttagcaagccaatcggtttatctgtatggagagcaatgcttttttgtaaggggaaatcaaccagtccaccgagatttttaggattaagtgcggttaaaataccgttgttgataatgcctgtcgatgcaaccgcaaccgcatcaaactgtcccgaataactttgcataatttgctcgatggcatgatgcaatgcgactgtaggatctgcttgtggcgtgctgatttgctgacggttagatagcttcttttcttcaacaacagcggttgcaatttttgtaccgccaatatcaattgctaagcaacgcatacttttttccttaggtttattaggatttagctgatttaaccgaggtgacaaaccagcttacaatatgttctaagcgagttaatgccgaaccaacagtaacacaatcagcaccaatttcaatggcggctttagccagttttggtgtgttgtagcgaccttccgccatcacataacaaccggcagcttttaaatctttaactaattgatagtccggttcttcgggaatatcaccacctgtatagccggacattgtgcttcctataatatcaaagcccagttgttggcaatataaaccttctttcagatttgagcagtccgccatggctaaacagcccaattcgtgaatttttttcaccgcactttcaatgtcaacaggacgtttgcgatcggtaccgtcaaccgcaataatatccgcacctgccgctgctaagccttcaatatcttgtagaaacggcgtaatccgtacaggactgtcttccaagtctcgttttacaattgcaataattggtacattcacgrscggacgagttgcttttaagttatctacgccttcaatacgcaagcctgcggcaccaccgataatggaggcttgagccatcgctgcaacaatttccggtttatccataggaccgtcatctacgggctggcaagaagcgatcaatccaccttgaatagcggttaaaacttgtttatgtgataatgttgacatataaaactccaaactatgggaataactgaacgttattccttttctttataaatattgcgttaatttacgggttagtacctcgtaaccttttcgattgaaatgtagaccgtcggtacacaaagttaaatctaattttccgtctttacccacaaaatcctgccaagtatcaataaaagttaaacccttagggcagtttttccgcaaataattatttaatgcaataatcggtgggttgtctgttgtggcaatattatttaccggcgttgcctccaataaaaagaattcggattcaggggaaattttgactaaggcttgccaaatatcacagatccaatccaatactttggcgtgagaatactcaggctctttaacaatgtcattcacccctaagaaaataaagacttttttacctaaatagttaatcaattgaggtttgataataacatttaaatattgtctagcactgacacccgaaatacctaggttggcaacacgtttgcctcttagttgaatttttggtgaaatatcactccacatatcaaagagtgagtgtccaactaaggtaatatcagcttgcttttcaaattccgcttttttaacttgataacggttgaaaatatcttgatctgtcagcaattgtcggtccttaatttaacaatattgactaatattggaacgaattatataaaaattgaattttctcgcaatgttatttggtgttttgctccagaaattatttaaatttgtgtgccacgtcacaattctgaaataaaactctataaatatattttaaaatgattttttgcttttagaatatactttcagcaacagtgcttttcccttcatatttttaataggagaacttacgatgaaatttgaaaaactcgctcttgcaactttagcgttgagtatgtctgcctctgtttttgcagcagattatgagctgaaattcggtatggttgcaggtaccagttccaatgagtacaaagcggttgaattttttgcgaaagaagtaaaagaaaagtccgatggtaaaattgaaattgcaattttcccaagtgcacaacttggtgatgaccgtacaatgttaaaacaacttaaagacggttctttagattttacattaggtgaaactgcccgttttcaaatcttcttccctgaagcggaagtgttcgcattgccttatatgcttccaaactttgaaatcagtaaaaaagcattacttgaaaccaacttcggtaaggggttggtccaaaaaattaataaagagttaaatcttgagttattgtctgtagcttacaacggtactcgccaaactacatctaatcgtgcaatcaacagcattgcagatatgaaaggcttaaaattacgtgtaccgaatgcggcaactaatttagcttttgcaaaatatgtaggtgcttctccgacaccaatggcattctcggaagtgtatttggcgttacaaaccaatgctgtagacggtcaggaaaacccattaccaactgtccaagcacagaaattctatgaagtgcaaaaatatttagctttgactaaccacatcttaaacgatcagctttacttggcaagtcgtgaaactttagaggatttaccggaagatttgcaaaaagtagttaaagaggcagctgagaacgcagcagagtatcacactaaattgttcaaagagggtgaaaaaaatttagttgcgtttttcaaagagaaaggtgttactgtaactactccggatgtaaaaccgttccgtgatgcgttaaaaccttactatgatgaatacttaaataaaaatggtgcgttagggaaacaggcaatcgaagaaatttcaactctcattaaaaaataaaaaatgccctttccctagtgagggaaagggatagcttttttgttcggagtatgtatgaaaataatgaacaagttagaagaatggattggcggggcattattccttgcaattttcctgattttgattgcacaaattgttgcacgtcaagttattcatatgccacttatatggtcggaagaattagcacgtttgctgtttgtttatacggcattattggggatcagtatggcggtacgtgcacaacaacacgtctatattgactttattaccaatttaatgccgctgacaatcaaacgtatggcgatgacctttgttcaattattaatttttgtctcaattattctgtttatctacttaggttatggcgtttgggcagacgcaacttttcctatggaagcattaaaagctacctttggaacggaaattacgcaaaaatggctctacgcagggttgccgattattgcatctttgatgttattccgttttttagaagctcaagcagaaaactttagaaacaaagccacttacttgcctgtttcttttttccttgtaagtgcggtcattatttttgcgattttatattttcagccgaagtggtttaaatctctgcgtatttccaactatataaaattcggtaaaaatgccgtttatatcgctttagcggtttggttagtgattatgttcttaggcacgcctgtaggatggtcattatttattgccgctttactttatttttcaatgacacgttggaatatcacttattccgcatcgggtaaattagttgatagcttagacagcttcccgttattgtccgtaccgttttttatcttaaccggtattttgatgaacactggcggtatcactgagcgtatcttccacttcgcaaaaacgttattaggacactataccggtggtatgggacatgtaaatatcggtgccagcttaattttttcgggtatgtcaggatctgctttagcagatgctggcggtttaggtcaattggaaatcaaagcgatgcgtgatgcaggctatgatgacgatatttgcggtggtattactactgcttcctgtatcatcggtccgttagttccgccaagtattgcaatgataatctatggtgttattgctaatgaatccatcgcaaagctatttgtagcaggttttgtacctggcgtgttggttaccatcgcattgatggtcatgaactactatgtttctaaaaaacgtggttaccctaaaacaccaaaggcgagcaaagcagaagtttgtgccgcatttaaagacacattttgggcaattttgacaccgtttttgattattggtggtattttctcaggtttatttacaccgacagaagcggcggtcgttgctgctgcatattccgtaattgtaggaaagtttgtttataatgatttgaatctaaagaatttcctcaaaagctgtgtagaagcagtatctattaccggtgtaaccgcattaatggtaatgacagtcactttcttcggtgacatgattgcccgtgaacaggttgcgatgaaaattgcggaaatttttgttgctgttgcagattcgcctatcacagtgttaattatgatcaatttgcttctcttattcttaggaatgttcattgacgccttggcactacaatttttagtgttgccaatgttgattccaattgcgatgcaatttggtattgatcttgtcttttttggggtcatgactacattaaatatgatgattggtattttaacccctccaatgggaatggcgttatttgtcgttgctcgggtgggtaatatgcctgtaagtgtggtagcaaaaggcgttttacctttcttgataccaatttttatgaccttagtattgattacgattttcccacaaatcattacatttatacctaacttgctaatgctttagcagtaaaactggggattgaaaagatagaagtcggtttatgatcgacttctgaagaaatctatttttcaatgtatatctggataggtatttatttttactcaacttaaataagcaattaagcaataatgttctatattatcattcgataaattaatttatcttaataaaagattaccaatcaatacaaaactcctgtacaatatctcagctttatttttccgcttagcgtgcggctaacgaaaataattttagtaaaagtaaagagcggtggtttttaagattatttttgctagtcgcaaattggaaaatagagcaataagattaacttactaatttataaggaaaatattgtgaatccaattgtaaaacaatttaaatatggtcagcacactgtaacattggaaacaggtgcgattgctcgtcaagctacagctgctgtcatggcgagtatggatgatacctctgtttttgtaaccgttgttgctaaaaaagatgtgaaagaaggtcaagactttttcccgttaaccgttaattatcaagagcgtacttatgccgcaggtcgtattcctggtggtttttttaagcgagaaggtcgtccatccgaaggtgaaacattaattgctcgtttaatcgatcgtccaattcgtccgctctttccggagggatttttcaatgaaattcaaatcattgctacggtagtttctgttaatccgcaaattagtccggatttagtggcaatgattggtgcatcagcagctctttcattgtcaggtgtgccatttaacggtcctatcggtgcggctcgagttggttttattaatgagcaatttgtgttaaatccaaccatgaatgagcaaaagcaaagtcgtttggatcttgtcgttgctggtactgacaaagctgtattgatggttgaatccgaagcggacattttaactgaagagcaaatgttggcggcagttgtttttggtcatcagcaacaacaaattgttattgaggcaattaaagagtttgccgccgaagcaggtaaacctcgttgggattggactgcaccggaagcaaacaccatattgattgaaaaagtaaaatctattgctgagaatcgtttaggtgatgcttatcgtattactgaaaaacaagctcgttatgaacaaattgatttgattaaagcggatgtaattacgcaagttacggcagaagatgaaacaattagcgaaggaaaaattattgatattttcaccgcacttgaaagtcagatcgtacgtggtcgcattttaagtggtgagcctcgaatcgacggtcgtacagtggatactgtacgtgcattggatatttgtaccggcgtgttacctcgcacccatggttctgcgatttttactcgaggtgaaactcaagcgttagccgtagcgacacttggtactgagcgtgatgcacaaattattgatgaattaaccggtgaaaagactgatcacttcttattccattataatttccctccatattctgtgggcgaaacagggatgattggttcgccaaaacgtcgtgaaattggacatggtcgtcttgctaaacgtggtgttgcggcagtgatgcctagcttgtctgaattcccttatgtagtacgtgttgtttctgaaattactgaatctaacggttcttcttcaatggcatcggtatgtggagcctctcttgcattaatggatgcgggcgtaccgattaaagcggcggttgcaggtattgcaatgggattggtgaaagaagaagataattttgtcgtactgtccgatattttaggcgatgaagatcatttaggtgatatggactttaaagttgcaggaactcgtgaaggtgtaaccgcacttcaaatggatattaaaattgaaggcattactgcagaaattatgcaaatagctttgaaccaagctaaaagtgcacgtatgcacattttaggcgtaatggagcaagcaatcccagcaccaagagcagatatttctgattttgcaccacgcatttatacaatgaaaattgatccgaagaaaatcaaagatgtaatcggtaagggcggtgcgacagttcgttctttgactgaagagacaggtacatctattgatattgatgacgacggtacagtaaaaattgccgctgtagataaaaacgccgttcaggaggtgatgtctcgcattgaagatattacagcagaagttgaggcgggcgttgtttataaaggtaaagtaactcgtcttgcggactttggtgcctttgttgctttagtaggtaacaaagaaggtcttgtgcatatttctcaaattgcggaagagcgtgttgagaaagtgagcgattatcttgcaattggtcaagaagtagtagttaaagttttggaaattgatcgtcaaggtcgcatccgtttaactatgaaagagttggcgaaagaccaaactaagaatgaagaaaatcttctgcaatcggaagagggttctccggttcaagagtaaatttgatagagtaacttgaagggcaaattatatttgccctgtactgtatctgattactttcatcaatatagtgttttaaatgtgctatccattgaaatttaatcaataatctttttgtttatcttcattgttatttgaacaatattgaaattttgaatgaagccatttatccagcaaaacaagactcaatataagcaagcaaataaagcttgttgtttttaattaggcatatatttccgttgggtatcgttttgccgaacttgtaaaattgattgacaagtaaataatccatgatgaatgaactcaaacatggattccgtgttgtgaaacgagctttacaacgattaattaacctaaggcaaaagcatattgagctttcctttttacattcgagtatttttaatgactgaaacaacaattacttttaatgatttagggttacctgaattcatccttaatgcagtgtccgaaatgggcttttcaactccttccccaattcaacaggcttgtatcccgcatctattaaatgggcatgatgtgcttggtatggcacaaaccggtagtggaaaaacagcggcattttctttgccattattggcgaaaattgatactaatgaaaaatatccacaaatgttagtaatggcaccaacccgtgagttggctattcaagttgctgatgcttgtgaacagtttgtgaagttttctaaggggatgcgtattgttattctgtacggcgggcaacgttacgatattcaattaagagctttaaaacaaggtgctcaagtggtcgtcggaacaccggggcgtattttagatcatattcgtcgtggtacattggatctgtcaaatttacagtctattgtattagatgaagcggatgaaatgttacgcatgggatttattgatgatgttgaaaccgtcatggcggaacttccggagcaacaccagaccgcacttttctctgcaacgatgcctgctccaattaaacgaattacaaaacgctttatgcacaatccgcaagaagtaaaaattcagtcaacacaacgtactgcaccggatattacgcaaagctgttggtatgttcgcggttttcgtaaaaatgaagcattattgcgtttcttagaagtggaagattttgatgctgcaattatttttactcgaactaaaacggctacattagatgtcactgatttattggaaaaacacgggtttcgtgcagctgcattaaatggagacatgacacagcaattacgtgagcaaacattagatcgtcttcgcaatggtagtcttgatattttggttgctactgatgttgctgctcgaggtttagatgttgaacgcattagtttagttgtcaattatgatattccgctggatgcggagagctatgttcaccgaattgggcgtaccggtagagcggggcgtgcggggcgtgcaattttgtttgttgagccgaaagaacgccgtttattgggtaatattgaacgattaatgaaaaaagcaattgaagaagtggaaatgcctaatcatcttgctttacaagaatgtcgccgtaaaaatttcgtagctaaaatcactaagcaattagaacatcatgatctagaacaatatcgtagcttattggaagatttatttacggcagatcaggatcaggaagacattgccgcagctatgttgatgttattacaaggcaaacaaaaacttattcttcctgaagatccggtgtttgaaaaacattcacgacgtaatgatcgtagagagagaggggagcgtcgaggtaaagaaaatccacgttctgagcgtcatgggtatggtattccgcaaccaatggatttatatcgtattgaagtcggtagatgtgatggtgtcgaggttcgtcatgttgtaggtgcaattgcaaatgaaggggatattcaaagtcgttatattggacatattaaactttatgacacttattcaacgattgaattgccacagggcatgccaaaagaattgttacaagtatttgctaaaacgcgtgtattaaataaacagatgcgtatgtctttcgtaagtgcggtcaattctgaggaagagtttgaagccggctcaggtggtaaacgaaaagggcgttatgaacgtgagtttcgtggtggacgtaaatttaatgaaaaaagtaaccgctctttttctgaacagcgtaaagaacgcagagaaagaaagagataaaagcaaaggggctattacagccccttctttctgataaagcaaataattaataaaaattttattaacgactgcggaaaataatacgacctttactcaaatcataaggtgtcatttcaaccgttactttatctcctgttaaaatacgaatatagtttttacgcatctttcctgaaatatgtgcagttacgacatgaccgttttctaattccacacgaaacatcgtatttggcaaggtttctaaaattgttccctgcatttcaatgcaatcttctttagccatttattcctctaaatatgaatgaaaaaataaaaacttcgggattatactctattaatgagaaagacgaaaagaatttattctattaaagggatattatttttatttagctaatattgaaaaatttatcggattgaaaaattgtatttactgactaaaaagattagtatttgactgaagttatactatattttttattaaaaaggataatctatgacaagaattgcaattattcccgctagggcaggttccaaaggtattaaggacaaaaatctccaattggtaggcggtatttcattggtcggtagagcgattttagctgcacaagaatctggtgtgtttgatcaaattgttgttaattctgatggtgagaatattctcaatgaggcggaaaggtatggtgcgaaaacatttttacgtccttctgagctggcacaaagtgatacgagaacgatagatgttattttacattatttgaatgaattaaagattgaaaaaggaagtgttactcatcttcaacctacctctcctttaagaagcggaatagatattcggaatgcaatggaaattttttcaggagggtgtaaatcagttatatcagcttgtgaatgtgaacatcatccttataaatctttcattatagaaaataatgagattattccacatagagaaatcagtgattttgaagcaccccgtcagcaattacctaaagcatatcgagcaaatggtgctatctatattaatgatattgaagcactattaaagaacaaatatttttttattcctccaataaaattctattttatgccaactcattgctctgttgatattgataatacgctggctctgcaaattgcagaaaaattaattcaaaatcaatattagaggttatatttttaaggataaaaatcagcgagatgtgtcgattattcgctatgctaaaattgtgctgtgttagcaattttcaaactttgatttatatttggaaaacatgaacattctcattacagggggagccggatttatcggctctgcgcttattcgttatctactgactgaaactgaacatactatcattaatgtggataaattaacctatgcagccaaccttgatagcttacaaagtgcggtactcaatccacgttatttttttgagcaagctgatattgttgatcaacctgtgataactcaaatatttgagcaatatcagcctgatgtagtaattcatttggcggcagaaagtcatgtagatcgctcaattgcagcaagtgctgaatttattcaaaccaatattgtagggacatttgctttgcttgaggttactcgtcattattggcttaaattgcctgcaaataagaaagagcggttcgtttttcagcatatttctactgatgaagtttatggtgatttaattgactctgaacaggcttctactgaaagtagcccttatcaaccaagcagtccctattcggcttcgaaagcagcttcggatcatttagtaagagcatggtatcgtacctacggtttacctattctaattacgcattgtgctaataattatggaccattccaacattcggaaaaattaattccacgtatgattttaaatgcagtgcaagggaaacctttgcctatttatggagatggtttgcaaattcgggattggttatttgtagaagatcatgtacgggctttatataaagtattacaaaaaggaaaaatcggagagagttataatattagtgcaaattgtgcaaaaaccaatctagaagtggtgcagacaatttgcgatttattagaacagctagtaccaaataaacctaaaggaataaagcaatatcatgagttgattattcatgtcgaggatcgtcttggtcatgataagcgttatgccattgatgcttacaaaatccaaacgtctttgggctggacacctttacaagattttaccgccggcctacgtaaaaccgttcaatggtatttgaacaatggaaattgaagaaatggttaagactgttagttaagcagagtagtgatacacacaacgacaggtttaatatttcgtatgcagtatgtaaaatagctaatcattaagaggtatatacaaggtttaaataaaaaacgttacataaaaattaaacaaaaaattaacaaaagtgtgatttttgtcatatttttgtaacattaggtttattttttcttctatttttgtttacaattcacatcgcatttatcgttgcaattatatcttataatttatttactggagtaagttttatggtcctctttttgagtatctttcctatcgttttattaatttatttaatggtaaaacgtaacgcattaccttcttatttggcattaccttggattgccgctgttgtattaattattcagttagttttcttcggtacagatattaagattgtgagtgcaaatattgcatctgcacttgtagcagttcaaacacctatcactgttattttaggtgctattttattcaatcgtttctctgaagtatcaggtgcgacgaatatattacgtaaatggcttggtactattaacccaaatccggtggcacaattgatgatcatcggttgggcgtttgcttttatgattgaaggggctagtggttttggaacgccggcagcgattgccgcacctattcttgtcggtctaggtttccctgcgattaaagtagctgttttgacacttattatgaactctgtgcctgtatcattcggtgcggtaggtacaccaacttggtttggttttggtcctcttcatttgggcgacggtcaaattttggaaatcggtgctatgacagcattaattcacgctttcgctgcattggtgattcctttaattgccttaagtttcgttgtaagcgtcaaagaaattcgtcgaaatattatctatgtttatttaagtgtatttgcttgtgttattccatatattttattggcacaagtaaactatgaattcccgtcattagttggtggtgcaatagggttacttatttcaattctacttgctaataaaggtattggcttggctaaggttgaaaataatattgaagctgcggttccttttaatgacgtagtgaaagcattgtttcctaccgcacttttaattgctattttgattatcactcgcctccaacagttaccgttcaaagcgatgatgaacgatgcgacaacttggtttgcggttcaattgggttcgttagggcgttttgaaatcagccatggtttaattttcagcctgaaagacattttcggtacatcaattaattccagctataaattattgtatgtgccggcactgattccatttgttgtaacagtattaattgctattccggtatttaaagtatcggcagcaaatacaaaagatattttcgttaccagcttccaacaaactaaaaatccattctttgcacttgtcggagcattgattatggtgaatttaatgttagtgggtggagatggttcaatggtgaaaattatcggtaagagtttcgctgctgcaacaggagagtattggactgtcttctctgcttatttaggtgctgtcggagcatttttctctggatccaatacagtatctaacctaacatttggtagtgttcagttatcaactgcagaattaaccggcttatcaacttcattaattcttgcgttacaatctgtcggtggtgcaatgggtaatatggtatgtattaataatattgttgcagtaaattcagtattgaatatccaaaaccaagaaggggcaattattaagaaaacagttattccaatggtaatatatggtattattgccgcactggttgcattgtttgttatcccgatttttttctaaataatgtatacttttggtaagcagtattctttgatgctgcttacttttatttattttaaattgaaatattggagttcttatgaatgtcaatttttatgtcacttgtattgctgatgtggtgaaggcaggcgtggcaaaaaatacagtattgttgttagagaaactaggttgcaagattatcttcttggaaaagcaaggatgttgtggtcagcctgcaatgaatagtggctatacaaagcaagcattggaaggaatgaagaatttagtatcaacttttgaggtaaatgattatccaattgttgcaccagcaggatcttgtgtttatgcaattaaaacttatcctgagcaattttctcgtttcggtgaaactgaatgggcagaaagagctcaaaaagtcgctgatcggtttcatgatcttactgattttattgtaaataaattaaaagtaactaatgttggtgcaaaattaacaggtaaggcggtttatcatccatcttgtagcttatctcgtaaattgggtattgtgaatgaacctttaacacttttacaaaatgtaaaaggattggagcttttacctattactaaccagcaaacttgctgcggattcggtggtacattttcggtaaaaatggcagaaatctccggagaaatggtcactgaaaaagttgagcatattacagaagttgaacctgagtatttaattggtgctgatgtgagttgcttaattaatattggtggaagattgaaccgagaaggcaaaaagattaaagtcatgcacattgctgaagtattaatgcaggaggataaataagatgtcactaaaaaccagtaatcttgcatttaaacagcgtgtggacaatcaaatccataatgaaatgatgcgtaaagcggtagttaaagctcaagaaactatcggtgctaaccgtcaaaaaatggttgatgaattggggcattgggaagaatggcgtgatttagccaaacaaattcgtaatcatgttttagcaaatttagatgcttacttatatcaattaagcgagaaagttcagcaaaatggtggaaaagtttactttgctgaaaccgctgaagaagctactcaatatattcgtcaagttgcgttagaaaaaaatgctaaaacaattgttaaatcaaaatccatggtaactgaggaaatcggtttaaatgaagtgcttgaaaaggaaggcatgaaagtcgttgaaactgatttaggcgaatatttattacaaattgttggagataaaccttctcatattgttgtacctgctattcataaagatcgtcatagaattcgccaagaattacatgatgccttaggttataaaggaacggaacaaccggaagaaatgaatgcttttgtgcgtaaaacattgcgtaaagatttccttgaagctgatattggtatttccggttgtaattttgctgttgctgaaacaggctcggtatgtttggttactaatgaaggaaatctgcgtttagctacaacagtaccgaaaacccatattgcagtaatgggtatggagcgtttagcaccaaccttccaagaagtagatgtattaatcaccatgcttgctcgtagtgcggtaggtgcaaaattaacggcttataatacatggttgacaggtcctcgtcttgaaggcgaaaccgatggtccagaagattttcatttggttattgtggacaatggtcgttcatctattttggaaagtgaatttaaggaagtattacgttgtattcgttgtggtgcttgcttaaacacttgtcctgcatatcgtcaaattgggggacatggttatggttctatttatccgggtccaattggatcggtaatatctcctttattgggaggttatgaagaatttaaagaattaccttatgcttgttctctttgtactgcctgtaactcagtttgtccggttaaaattccattggcacaactcatctcaaaacatcgtgaacacattgcacaagctggtatgacaccaatgttagaacggttgtctatttttggctttactttagcaaactcaaatccgacgttatggaaaataggtgtaaaaattggtgctaaagtggcggctaaagtgattaaaaacggtaaagcaccaattgaggttggagcgttggcagagtggactaaagctcgtgatttaccaacaccagatggcgagagtttccgtcaatggttccaaaatagaggtaaaaattaatggatttacaaaatcgtgataactttttaaataaattggctaccaaaatgggcagacctcgccaattcattcctgagcctatgcctgagttggtcaataattatccgacaacgcgtttaactgagttgagcaaaaccgacttagttgatgagtttgtgcgttttgctaaagtgatgatggcggatgttattgaaacaagtgaagctgaactaaaccgcactttactggaagtttgcgagaaatatggtggcggtagtgttattttaaataatgacaaaagattagctgatttgggtattttgcaatctgtccaagaaaaatacgatagttatatttgggatttaaatcaaacggaagaaaattttgcccaagcagaaaaagctaatattggtattgtgtatggtgagtatgggttggcagaatccggtggcattgttttattttcggataaagattttggccgttcagtgagtttattaccggaaaaatctattgtggttttacgtaaaagcactgttttaccacgagttgcacaattggctaagattttacatgaaaaggcacaacgaggagaaaggatgccttcttgtataaatattatttcgggaccgagtgctacagcagatattgagttaattaaagtcgttggtgtacatggaccggtacataaaatttatattgttattgatgacttataattgataattaaatcgttaaaaaaatgaccgcacttctgttgaagtgcggtcatttcttatttgatttataggttatggcaacacattacttttaagccattgttcaaattcgttattgttcataaaacctgttatacgagcttgttctatttcctttcctgattgatcaaagaaaatgatagtcggcaatcccaaaacagtcagttgcttcatgagttcagtattgtccgaactgtttttggtcatatctacttgtaacagtaagatatgctcaaataaaggctgtacatttgaagcactgaacgtatatttttcaaactctttgcaggcaacgcaccaatcagcataaagatccaacatggcaaccgatcttggattattagcaagaacttgttgcaattctgcataattttgaatgcgttggaattgagaatgagagggttgttgttgaactgcgttttgttcgtgattccaatttgaattgagcaaaaaaagtgcggtaaaaacaaaggcgataatccaacctaaccagttttttcttaattgaataaaaaaccagacaatgaaagcaaacaaccagcttgcccataaataatcactatattcaggtaaaacacgagaaagtaggaaaataggtaacagtaacatgacgaaaccgaaagcggctttgaccttttccatccaaacacctgactttggtagaattttgttgccaaacaaagtaattaacatcagaggaatgcccatgcctaaggctaataagtatagtgtaaatgctccagttgtgagatcgcctgtttgtgccacataaagcaatgcacctgataatggtgcggaagtacagggagaggcaacaagacctgcaatcattcccatcacaaaaacaccgccaaaagcaccgctcttttgctgttggctgagtaaggtgagtttagtttgtagcgagcttggcagttgtagagtaaagactccaaacatggataatgctaatagaataaaaataacggatagactgactagtacgtaaggactttgcagtgctatttgaaatggtaatccgattgccgctacaattaatcccaatgatgtataggtgagtgccataccttgcacataagcaaagcttaaccccaatgctcgtaaactattcggtctttgatttgcaccgataataatcgctgacaataagggaagcataggtaagacgcaaggagtaaatgcaagccctaagcctaacaagaaaaaacctaatggtgcgtatttgttgtttaataagtttgcagcaagttgattttgttcagggtgttgcatggcagtttttcccgcaacacttaacagatctttgttaatagagatttcttgagtttcaggcggataacaaagtcctttggtacaaccttgataggtaatgagtgctttattaaaagaactatccgttggaagattgatggatagatctaattgatggcgataaatctcagtttctccaaaaaattcatcttgatgtagctcagcggtagggaaatgaagattctcaatagaaacacgttgatttttgttatcatcattcactaattcaatgctgatttcttttttatacagataatagttttcagcgatagcccaatgaagatcaagtttttttccttcttgttgaccactgaattgaaatgcttcatggctttttaaaaattgtgtttttttaccgaaaatgtttccttgtgcttgagacgcaaaaaaaagtgcggtgaaaaaaatataaaaaatagttaaaatttttttcattcaaatgatccctttctaaatagtttaatcgttcaatttatgcagggcgacataatatccgtggcatcagattaaaacaagcgttttatgatctacgtcatgaaatctagttgtatggaaaaaattatctcttttcacttgttacgataatgttgcaattatacaataagccccgaactgaattggattatattctaggaataaagtatgaacataccgcaaattttgattgttgaagatgaagtgattactagaaatatgttaaaaagtatctttgaggctgaaggttataatacgctggaggcggctgatggtaatcaaatgcatcgtatacttgctacatgtgaaattaacttagtgattatggatattaatttaccggggaaaaatggtttaatgttggcacgtgaattgcgtgaaaatacaaatacagcattaatgtttttaaccggtcgagataatgaagtagataagattttaggtttggaaatcggtgcggatgattatattactaaaccgtttaatccccgagaattgactattcgtgcaagaaatcttttacagcgtacgatgcaagaaatacctaaatctggcaccagtcaggtagaacagtatagattcaatggttggacattagatttaaattcacgttctttaattaatcctgacggagaagaatataaattacctcgtagtgaatttcgagcaatgttgcatttttgtgaaaacccaaagaaaattcaaactcgtgaagagctattgagaaaaatgacgggaagggaattaaaaccacaagatcgtacagtagatgtaacaattcgtcgtattcgaaaacattttgaagatcatgcagatactccggaaattattactactgtccatggtgaaggttatcgtttctgtggtgaattagaagaaaactaattaatttgaacagggtaaaaagtgtcatccttttggtattttttgtattggtttgtacactgccctttttctaaaaatgaattgaaaatagatctcactactttcactactttttctagtctaatattttgataagaaaagcatttttaagtaayggaaatctcttaaaaataataagtcaaagagttttattttttgtttctcgtaaggcttgtaaaatatttttcattgcgagatctaatggagcaactaggcgtagcctttcccctgttttgggatgttcaaaacaaatagcaaaagcatgcaagaataaacggtttaagccaagtgcggtcatttgttgatcaaagtttttatcaccatatttatcatcaagtgcgataggatgacctgcgtattgggtatgtacacgaatttgatgagttcttcctgtaataggagatgccttaactaaagtagcattattataacgttcttcaacgctaaactttgtttctgaaggcttaccttgttcacttacttttacaattcgttcgccactcgtaagttcatttttcaacaatggtgcttgtatcatcttacaatgagattgccaatgaccacgaactaatgccagatattctttttgtatggttttttcacgtagttgctcatgtaggctacgtaaagcagatcgtttctttgcaataagcaatatacctgaagtatctctgtccaagcggtgtactaattctaaaaaacgtgcttcagggcgtaatgtacgtaatgcttctattgctccaaaatttaatccgctaccgccatgtactgcaaggcctgaaggcttgtttaacactaataaataattgtcttcaaagataatttgttgttccagctgtgcgactttattcaatttttttgaaataggggtatgttctttttccgcaatacgaaccggtggaattctaacaatatcgccactttgtagcttatactcaggtttaattctgcctttgttgacccttacttcacctttacgcaaaattcgataaatcaaacttttgggtacgcttttcaattttgccaacaaaaaattatcaatacgctgtccactttcatcttcattgattgttagtatttttacactttggtttatgattttttcattaatatgtgtcatttttaaattttttcagcttatcaaattgttacgtatcatagcataaaaataggaattaccttgctaaaatttatttatcagtagataatagagcctatttttgggtaggtaaaatactcaaaactaaataagtcatcattgatcattttttaatgctgcgaatggcgtaagacattaatatatgaagtgatttcttggtagattaaagtaaacgacagcttgcaaaattaaacatttcaataattttgtttgtattaagaaagctattttaacacccgtcttaataacgcattcaatgcatccggcaactgacagtcgagagacaggcattttgtgacagataagaggtagattgcgaagcaaagagcggttattttaatgctaattttgataataaaatttagagaaaatttagacaatgaaaagaatgttgattaatgcaactcaaaaagaggagttgcgtgttgctttagttgatgggcaacgtttatttgatttggatattgaaaatcctggacatgaacaaaaaaaagcaaatatttacaagggtcgtattactcgtgttgaaccgagtttggaagccgcatttgttgattatggtgcagaaagacatggttttttacctttaaaagagattgcacgggagtattttccggatgattacgtttatcaaggtcgtccgaatattcgagatattttatctgaggggcaagaagttattgttcaggtcaataaagaagaacgcggtaacaaaggagctgccttaacaacctttgtgtctttggctggaagttatttagtcattatgcctaataatcctcgtgcaggtggaatttcacgccgtattgaaggggatgaacgtttagaattaaaagaggcattaagctctctggatgtgcctgaaggcgttggcttaattgttcgtactgccggtgtcggtaaatcacctgaagaattacagtgggatttaaaagtcttgttacatcactgggaagcgattaaacaagcctctcaaagtcgtcctgccccctttttaattcatcaagaaagtgatgtgattgttcgtgctattcgtgattatttacgccgtgatattggcgaaatattaattgatagcccgaaagtgtatgagaaagcgaaagcacatattaaattagtgcgtcccgattttattaaccgagttaaactttatcaaggtgaagttcctctgtttagccattatcaaattgaatcacaaattgaatctgcgttccagcgggaagtaagattgccttccggcggttccattgttattgatgctacagaggcattaaccgcaattgatattaactcggctcgttctacacgggggggtgatattgaggaaacggctttaaatacaaatttagaagcagcggatgagattgctcgtcaattacgtttacgtgatttaggcgggttaattgttattgattttattgatatgacaccggtacgtcatcaacgtgaagttgaaaatcgtatgcgagaagctgttcgtcaggatcgtgctagaattcaaattagccgtatttcacgttttggcttactggaaatgtcacgtcagcgtttaagtccttcattgggtgaatcaagtcatcatgtttgccctcgttgtcagggaacgggaaaaatacgtgataatgaatctttatcattgtctattttacgtttacttgaggaagaggcattaaaagaaaataccaaacaagttcatactattgttcctgttcaaattgcttcttatttattgaatgaaaaacggaaagcgatccatagtattgagaaacgtcataatgttgatattgtggtagctccgaatgaagccatggaaaccccgcactttagcgtttttcgtgttcgtgaaggtgaagaaataaatgagttaagttataacttagctaagttgcatgaaatgaatgatgagacttatgttgttgaggaagcttttatttctcgtcaccttgaaaattcagcagcaacagtggaaagtgcagtcgagaatgcggcggtttcattagctattgaaactccggcaccaatgccacaagaaagaaaacaagagagagaatccttattgagacgtattattgaggggattaaaaacttgtttgctgataattcaagtaaaaataaaaaaaacaaaaatactcgtcagaataaaaatgctcgtcataatcgtcgtaaccaagatcgtcgttctagccgtcgtattcgtcaagagcatgagattaaatctgatgaaaataataaattagatacacagcatgctcattatactgaacgttattctaagcatgctaagaaaggcgttgatgatccgcaaattcagacaaagaaagcgggtgagttggaaattcacacaaaagatgatgagactattgaaacaattcagcctcgtcgccaacgtcgtgatttgcgtaagaaagttagagttgaggaaaatttagttgatacgacaaatttgggagcaactgaagaacacgttgaaaatgaaaaaacaacagagcctgttacaagtttagaacaagcggttttacagacagaaaatgagaaaactcatgaacgtcaagataataactatcgtcatcgacgcttacctcgtcatttaagagtgaataatcaaagacgtcgtcgtaatgtagagttgaaatctgcgatgcctctatttgctgcggtagcatctccggagttagcgagtgggaaagtttgggttgatgttaatgtagttaattcaaaaaataacaattttttatctgtagatgaattactaaaacagcaatatcaacaagaggaaattgaagttgttattcctgctagtgaaatcttgatggatactcaatctgatgatattaagcctttaagtaactttgttagccaaccagcaaatgaagcagttgaaaagaaagttcaagaaaccttgcaacgtttaacccaagaggtggttgacgaatcatcaacaatcgaacgcacagaggtagatactaatacttctgtacctgagtttgtacgtgaatatcagtttaacggacgattggggacaatttctgcggttatgcatacgaaagcagaaatgacacttgccaagtcaagtgatgagccaatgcagcctttctcaatcgttgaatggcaagattctcgttattatttctatggtagaggagcggcaggacatcattgtgcaatcagccatgtttattctgaacctgctaatactaaaatagaataaatattttacatgaatgaaaattccacgcttgaatggaacatgagaaaatcatggacaatacaggcgtggatttttgtttttataaagtcataaaataggtataacaaagaaaaatctatagaataactttcttggttctgatggaaaatatcgtaaaacttctttttgttttttcgcaagtgagtatcggcttaaaacactctgtcataggtacattgtagcagagaagagtttgccatagtttagaaattttgaaaatgtttcaacacattgcaggataggggttaaatggtsccccctaccggacttgaaccagtgaccaagcgattatgagtcgcctgctctaaccaactgagctaaagggggacaggtcgtggattatattgaataaaaataataaagtctataaaaaggagattaaaagcttaaaattcattcaatctcttgatttcaactattaatgtgcctcatcccaattatcacccacaccaatatccacaattaatgggactgataaatgtgccgcattttccattaaagacttaattaatgcagaatattcatctaccttattttctttcacttcaaataccaattcatcatgaacctgcatgatcatttgaatatcattttttttgatttcgttatgaatagcaatcatagctaatttaataatatctgccgcagtaccctgcattggtgcatttatcgccactcgttcagctcctttacggcgtattgcattagatgaattgatttcaggcaaatatagacggcgtccaaataatgtttctacatagccctgctcttttgctttttctcgaatatcaaccataaaagtttgcactcccggataacgttggaaatatagatccatatatttttgagcatttgcccgtgaaatgccaagttgattagataaaccaaaagaactcattccataaatcaagccaaagttaattgcttttgcacttcgacgttgttcacttgttacttcatttaatggaataccgaaaatctcagctgccgtagaacgatgaatatcttttccctcattaaatgccgtaatcaaaccattatcttgagataaatgtgccataattcgtaattcaatttgtgaatagtctgcggcaataattttataccccttacgtgcaataaaggcttggcgaatacaacgaccttcttcatttttaatcggaatattttgtaaattgggatcgctggaagataaacgtcccgttgctgttactgcttgatgataagatgtatgcactcgtccggtttttttgttcaccattgaaggcaatttatcagtgtaagtagattttaattttgctaatccacgatgttccatcaataatttaggcacaatatgtccctgttgagctagcgtttccaatacatcttcatttgttgaaggtgcaccttttggggtttttgcaatgataggtaaggctaatttagtaaagagaatttcttgtagttgtttggttgaagctaaattaaattctgctcccgcttcttgataaacttgttgctcaagtgcggtcaatcttctcgcaattttttcagattgctttaacaatgcctgactatcaattagtacaccattgcgttccatctttgataatacttttaccaaaggcaactcaatatcattaaataccttcactaaacttggcgattgttgtaattcttgccagaggacttgatgtaatttcattgtaatatccgcatcttcagcagcatattctgtcgcttgagcaatggcaattttatcaaacgttacttgtttttttcctttaccggcaatactttcaaattcaataacttgatgtcctaaatatcgttccgataaggcacccatattatgtcgtcctgtgctgtcaagcacataggattgtagcatcgtatcaaaacagacaccgtttaattgaatatgatgattggcaaaaatagttaaatcatatttaatattttgtccaactttttgaatagacggattttctagcaacggctttaattgtgctagacacgtctctttatttaattgattttttacaagctcaaattgttcagcattttgttctgattcagtgaataaatctgtttgtgtcatttcttttacagcttgtttatgagccagaggaatatagcaagcctcgctgttggtcagtgcaaaggaaataccgacaagattagcacgcataggatctaaagcatcggtttccgtatcaacagcaataagatctgcctgttgaagtttttccagccaactatttaatttctcttgagtatcaatagtttcatatgaagtgcggtcgattttaatcgtttttttgaccgcacttttcgactcagaggcactatttgtttgagttttatcaagtttaatttcttgctgagttgctttggtaagtgagctttcaccgcttatcacttcgtttagccaacgtttaaattcataacgagcaaagtattcaatcaattgatcttggttattttgccctaacacgagttgatccggtgtaatatctaactcaacgttggtttttattgttgctaaaaggtaagataaatccgcatctgccttggcggaggatagtttctccccgagtttttttgctcctcgaattgataatccagccactttttctaaatttgcataaatttccgccatactcccaatgccttgcaacaatcccaatgctgttttttcaccgacaccgctaactcccggaatattatcggagctgtcgcccattagtgctaaataatcaacaattaattcaggcggaataccatatttgtctattacaccatctctatccagtaaactgttattcatggtattgatcaacataatattatcatcaaccaattgtgccatatctttgtcaccggtgctaattagaacgttttttccctgctgagaggcctgaaccgctaatgtaccgattacatcatcagcctcgacaccttcaacagacaacagcggaattcctagtgctttgataatattgtgtaatggctgaatttgttgacgtaaatcatctggcatagggggacgatgggatttatattgttcaaatatttcatcacggaacgtttttccctttgcatcaaatacaaccgctatatgggtcggttgaacctgagcaattaaactttttagcatattcaatacgccatacattgcacctgtcggttcgccaagagaatttgttaatggaggaaaagcatagaatgcacgatataaataagaagaaccatctacaagaacaagcggattttcagcaattttagccataatagaataatctcaaataacacaaagagcggttattatagagcaaatttttgagggaggcgaatttgaaaccggaataaacaagactgaaaagaatatattttaagcaatgcaaaataaatccttagacttacgcaacttaaagcaatacaatttcccatcaattttgtcgatgtttttaaccgcacttttaaaccaaaagatcttatgaaactcaatgctcaacaacaacaagccgtagaatacacacaaggtccttgcttagttttagccggtgccggctccggtaaaactcgggttattattaataaaattgcttatttaattgaacattgtggctacttaccaaaacaaattgctgctgttacatttactaacaaagcggctagagaaatgaaagatcgtgttgcacattcaattggtaaagaaaaaacaagaggtctgcttgtttcaacttttcacactttaggttttgacattattaaacaagaatacaaacatctcggttttaaagccaatatgaccttatttgatgaatatgatcaaatggcattattaaaagagattacggcagatctattaaaagaagataaggagctattgcaagagacagtttcggcgatctctcgttggaaaaatgatctgattcttcctaaacaagcgttcactcaagtaagagacagtaagcaacaaacttttgccaagtgttatgagcgttacaataatcaaattcgtgcctacaatgcattagattttgacgatttaattatgttgcccactttattatttctccaaaatcaagaagtgcggtctaaatggcaagaaaaaattcgttatttattagttgatgaatatcaagatactaatacaagtcaatatgaattagtgaagttattagtcggtcaacatactcactttactgtagttggtgatgatgatcagtctatttactcatggcgaggtgcacaaccgcaaaatatggctaggttaaaaaatgattttccacaattacaagttattaaactggaacaaaattatcgttctaaccagcgtattttgcattgtgccaacatcttaattgcaaataatgatcatgtatttgaaaaacgtttattttctactttagagcaaggtgaaaaactacaagttctggaggcaaaaaatgaggagcatgaagcggagctggtcgttggagaattaatcacccatcgttttatgtataaaaccaattatcgtgattatgcaatattgtatagaggaaatcatcaatcaagactattcgagaaagtcttaatgcaaaatcgaattccatataaaatctcagggggaacttcttttttctctcgagcagagattaaagatatgatggcttatttacgtgtactgataaatcaagatgatgatgcggctttattacgtattattaatacacccaaacgagaaataggctccgttactttggcaaaagttggaaaacttgctcaagaaaaacatattagcctttttgacgctatttttgattttgacttaattcaccaactcaatcccaaatcctataatgccttacaaggctttgcatattggattgtcgaactcaatgacgaaattcaacgctcagagcctgagcaagcaatcaaacgaatgttggcacagttacattatgaagaatatttatatgaacatgccaacaaccctaaaattgcagaaatgcaaagcaaaaatgtagccacgttatttgaatgggttgcagttatgctaaaaggagatgagttcaatgaacctatgtctcttagtcaggttgtcagccatctgacgttacgagatatgttggaacgcaatgaaactgatgaagaaagtaatcaagtgcaattgatgacattacatgcctcgaaaggtttggagtttccacacgtttttttaatcggaatggaagaaaatattctgccacatcaaaccagtattgatgaggataatgttgaagaagaacggcgtttagcttatgtaggtattactagagcacaaaaatctctcacattttctttatgcaaagagcggaaacaatttggtgagattttcaagcctgagcctagtcggtttttatctgagttaccccaagatgatcttcaatgggagagaaatgaaacacatgcaacagaacaagaaaaaaaagaaatgaaaaatgccggatttgccagtttaagggcgatattaaatcaataatgctacctattataaattttatacctactttgtagataaatcagacaaccaaataaattttataaaaaatcgtttgacttatttttagaaaaacgtattataccgcccacaaaccgattgtggtgagatggccgagccggctgaaggcgctcccctgctaagggagtatggggtcaaaaactccatcgagggttcgaatccctctctcaccgccatttactcagtgcatccgtagctcagctggatagagtactcggctacgaaccgagcggtcagaggttcgaatcctctcggatgcgccatgttgatttttgattttattgaactctacaataaaacatacacaataatacattcggttaaaaatcaaactaatacgcacccgtagctcagctggatagagtactcggctacgaaccgagcggtcagaggttcgaatcctctcgggtgcgccatcatcaaaaacccctgataaacaaccaactatagccccttgcgatctaaaataaaaaatgcttraaaawcaagtattttttgcctatyyaaaaacaaagtattrtatttatatacagtataaattatgatctaaaaaaaccgattayagaatttaactgttaccaaaaactratccaaaaacaaaaaaagtgtaccaaayaaagaaaaaaggggggatgraatggcaacttaccaaaaacgkggagacaaatggcgagcaatagtccgcaaaaagaacgttctaaaaacaaaaacattccgcacaaaagcccaagcgttcgcatgggcaaacaaaatagaagcggaaataatggaaaatttatatcaagaagtggctaacatccctctagaaaaagtgatagacagatacctacacgaagttacaccacaaaaacgaggagcaaaaaaagaacgacaatttctctaccgtttccaagcattacccatcagcaaaatatcactgagacacctaaacgaagacgacttcaaacaatggcgagatgaacgactaaaaaaagtctcctcagcaacagtattaagagaatgggcggtcatcggacacatactaaacgtcgcaatcacagaatggaaattactcaaaaacaacccactaaaaggggtcaaaaaaccgaaagcccccaaaccaagaacaagacgatacagccaacaagaaatagatgccttagtctatacatccggtttttcttggaacgaaccgccaacgacagcgaccgcaagagtaggagcagcgatattattcgccatagaaaccgcaatgagggcaggagaaatagtcaacctaacatgggaacacgtccattttaacgacaaaatagcccatctcccacaaacaaaaaacggctggtcaagagatgtacccctatcaaccaccgcaataaaaatattaaaattattggaacaaatcgcagagggagaaagcgtattccaattatcaacctcaagactggatgcgttattcagaaagttaaaaaatagaatgctactggaagatttacattttcacgacacaagacgagaagcactaacaagactggcggaaaaagtcgacgtaatgaccttagcgaaaatatccggacatagagatctaagtatcttacaaaacacctactacgccccggatatgaaaaaagttgccttattactggattaacgttttgctcgttgacgtttacgagcaaacgcaatcacatcgcctgcaatccaacgattagcagaacgtccacccgtgcgacattgcaacttcaccgcatccggaaaatccggatcggacataatagaacgtttcgtatgctcatagctcatcttaaaataagtagccacatcttgagccgtccaaatagcttgattagtttgcgtatagtttgccaccttcaacaactcacgcacagcttgcaactcccttaaaatatcctcattggttatcgcttctttcatcgcttccataaaaatttcctctaaaattccttaatttctctaaaaaactcggctcattatgctcattcccataaaacgaacgtaaaggcacagagtggtctgaaataatcacctcatcattgattatttttaccgatgtcatcgcattcaatctaaccgatctacctttcaataaatgattaattgcatgctcattcaacggtttcccaattggtcgtattgcctcttttattttttgaacaatttcctcccttcttactaaattttcaaggttacagttactgacacaagtccaaggttgcactacgtgcaacttagtgtcgctccgctccatttctttattacgtctattcggatcacctttcttaatgacccactttttaagacgtgttttaataaaatcacctaaactaaatttattgctcaccccatttatttttttatgcgtctcttggtattgattaacctcgctttcctcataatgcaaacacaacggcacatccttacgcaacgccaacggacccccaagacgtttcataaaagcagcataatcgccaatatctgcacaaattcttgcctcttcaaccaattcattatcagcttgaccggcaacaagacggcgtaattcacgccacacaccgacatatttatccccataaaattgaaactgacgaataccccaaaggctcgcccatgctctcgcttttttagcattatcttttaaactcatatcggcatcttcatcagaccgctcaccatctaaagcaaaaccattaatattttttgaaatatacttagcaatataccccgtcgccgaccccttagttttatcgcagtcttcaattttacagcgatgttttttagcccccatttcatcaccgtcaagctccaacgctttttcacgaaacaatctcaccacctcttcacgatgcgtctcatggatataaaccaacaaatgccaatggggcgttgcgtcatgatgaggttcagcgacacgcataccataaaaagcaatattacgttttttcaataacgccctgaattgcccccaaatcttattcaaatagtcctgcgtttgcttaggattagcccctttccatttcttattttgcgtaccgtcattatggattgcatggaatgatgaaggggcggtcagcgttaaaaacaacgcatgatgatcggactcatccgcccactcttccaacccacgtaaacgagtcatcaactcaatccgacgctgagcaggattcgcagaagatttcaaatacatatcaaacagctcagcttgctcattcggatcgtcgacattctcaataatcatctgtttcaaaaaatcatagtttttcttaatctcatgcaaatactcagaaaaaccggctcttgaaatataattgcttctgcgtttgcaaacctcgccacaggcaatcgcaacatgctcaaccatctttttctgcaccttccgcatacgcttaaaccaatatttctcacaaataatcttatgaaaaaccgtatcaatataatccaatctaaccggctttcctttcttaaacttatcccaatgggaaacaggaaaaccaatattttcacaagcctcaccgcataactgataaatcttccgcatatgctcattaaactcatcatcgcttaaatccgaccgccctttttccaccaaatccaacatataaccacgctgaacattagcaaacagcgtcgccaatttataagcaatctcctccagcttcttctcgctcaacaaataaaaaggcatttttgcacgttgacattcttgacggctataatgctcaaaattcttgcgtaacttcaaaatctcatgttgctcacgcaacaaccggctttcatattcctccggctcgccggttaccggcaataaatccccattgtgcggttgttttttttccaacacatcaaaggacaaatccgctaaccattttggatcacgttcatcaaacgccaacaaccacgccatattgcaacgatactgatcgaacacaaggcgtaaacgagtacccaaggtttcacgcaaccaagtattagcatgtctacgttgtttattcccgaaagcaaacgaaatcgacccatcatcttcaacagaccgatattcatttaaatacaaacgccgaaaatgctcacgttgtcgttcacgtggcaatttcgccaataatttctcaacaaacacatagctttcgggaacagtattaaaaagctccatctgagcttgtgtccctgttttttcctctttatgaggaacacgaggggaaacctggaaaaaaggcaccgcagtttccttttgctcgtttttaaataccgtcacgaatgccataaaagcctactcaacaacttaaaacgatggcggaatatgagccttcaactctcgcacttccgcataaatcgcctgcaacacattaagaatatcaaacaacgtattcacatcctcattgcgtaactcacaacgaattaacgcctcaatgacatcctcaaattttctaaaacacatcacctgccgagccgagctacctttctgctccagcataaaaaccgctttttcgcccggctcaacctttaaaatctcataaacaccctgacgaattcgtaacaaataacaatcagaaagctcaaaaatataatccgtcatacagaccccttcacaataaaatcacgctttttcacccccgcatgatagaacggcaaaagtgcattcaacgtactaaaaatggcatttgaaatcttcttctgcccggattcattaaaatgtatcaatttagaatattgataattcaacggatcgaccaaatccgacgtctctaatttcgccttatcaaacaacgcatatttctgctccatcggcaaggcatcaaaaatacgctcggcagcattaggcgactgatttaaaatacgccgcaaagaagcaaaccccgccttagaaaccgcctcatgatcgggtaaccgctgaacaataatgctctccacatcaaaatgacccataactccccctcaagcctagcgagccaaaaaatcccaaaacgacgtcaaaaaacggcgaacgcaacctagtttcggcggttgttttttcacagcgggcaacacgacacgctccaactcgctcaaacgttgaaaaatttcctcattagtgatttgataactttgatgaagctcaatatttaccctatgcatttttttttgtatttcaaatttacgttcaatatttgccaaacgcttttccaacttaaaaagattgatgcgttttttattcattgccgtacatttttgatgaaatttttgtttaatcatgttgtgtttcctcatatgtgttgttttccatttrkgcraatrtgattgcctactgtaggggcggattacatccgcccttttttaggttgcaaaaacccacgccattaaaaaacagcgattttttatctaaaaagaaagaaataatagattacgtgtcttcgtcgattggacttgcctcaaacaaatccttcgtatttgtatcgctttgtaacaacggtttattaatccgctttacctccggacgctcatgataagtaggcgtttgcaccgtcacaatttcgctataaatatgatgtttagtagaacaactattacaaacccaaattgcctcaatcaccaacataccgacggattcagaatgacgaacccgcatactatgactaccgcaattggcacacttatgattcatatttgccatctttacgctcccagcattgccgaataacctcccaatccacatcagggcgtaaatcctcgggcgttacctcgccttgcgtggcgttgataatatgcggtatatatttcacgtccatttttccgccgtttagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggtgaaacccgcaaccctaaaaatatagttgaaatagcgaccgcacttggcgttgatgtgcattggttaaagacaggcgaaggagaacccaatattacgcctcattcttctatattggtgagcaatgaacccgacgaaaagcatactcaccgcataaaccgatatgattttcacctatccgccggagacggaatcattaactcggattacccggagaccatttcgagcatttggctcacccctgaaggtatgatgcaaataatcggacgttatagtgaaaaagggatctgtatttttaaagtccccaccgacagcatggaacccaccatctcatcaaaagacctcgtttttattgataccaatattacctattttgccggcgacggaatttatgcctttcgacttaacggcaaagactacataaaacgcctccaacaactccccaccggcataatccgagccttaagcgacaacaaactttacgaccctttcgacattacagaagaattattcgacaccgcagaaatcgtcggaaaatttatccgagtcgtccccctcaacccaaaggatttgtaggggatatttttagctcggaaaaaggaacgttaaatatgattaaacaaaaaacaaacaatttcttcttcaacacaaaggggataaaattggcgatgtgtgatacagataaattcacacgaagacaacgacctaatccggctgacaaaggaaaacaaccctatgaagacgatgacattaattcaacgcaaacaatcccttgagtttgatattcaacgttctattcgttataacagtaacgtttgataacgtttggtaaatttttacaagccctaactcagggctttatttttcctcgccacgattaatatccaactccaattctaacgaggttgtaaatccgcttgtggtgagattatgggtaactttactgattatccaattgctactgtcgatttggtctttaaaccctcgcacttttacacgcaattccggcataagaaaagcattgccataggctaaattcatcgaaaaggtcgcaacaccccttttcattttgtcaaacgccgatttagcggcttttaacgcataattttctgttttgtaggtatgccttaaggtttttattttatcgctatcgctttctatcggctttgtttgcacaatcttatattttttcttggttttggcggtttccgtacttgttccgcccccctctgtggggtgtgtcggctttgcaatacgttctattttggtattttcatcaatcactacaacgccctttttgcctgtgtccatattatgccaataagcacgaaccgctttataattgtcgctttctgtcaacgaaaaattaaaattatcgcccagctgtcttgtgatctcaattgtcggtaaagtcttaccgctcacactcaaccccaatcccaccggcataaataataatttaccgtttttcaccgtcgcaatggcatcgtaattttccgctaaacgacttaacaaattaatatcactttcgttagtttggtctaagtgcggtatgattttttctttgaacgcttcagcacaagccccctcaagttgattttcttttgcaatctgattaatcaaattttcaaatgaaatattatcaaaggaacgttcttttttatcgctaagtgagcctctcaaatccgcacttcttgcacgaagagtaagactatccggacttccgctatattgcagttcatcaacaataaatttacctttcggaattaattgctccccttgccaaccaatggctacttcaagcattgccccacggcgaggaaacgccaatttcccgtcatggtcgcttagctgaatatcaatttcgtccgcttcaaatcccctgttatcagcaatcgtcatcgacattaagcgatggctaattagcgtagtaatgtcttttttgttttcatcttgcgttatcaccctcaagcgataatgaggaatccgatgatgatttgctacagtgcggtctaaaaattcagaatagctcatagttcaattaaactctttaacgtatcgccaatatcttttaacaaactttcgtttgtccgttttaacttcattgaaaaatcaatgcgacgtgaagcaccgtccgcaaaaaaataggatttcccgacgctaatttcctcaatgacaaaccagcctaaaacaagaaaagtactcccatcaattaacggcaagggctccccctgttccgctaaggtttcaagggcggtaatactgagagtagatcccgtaatttcaggcattaacacgccatgaatggttaatgtttcgctatcctttcctgtaaattgtgttttgggtaattcccctatcactgaatttgtcggatgtcgccacgtaatagttctttgtgtctcctgataaggtatcgttgaccgcataaaaacaaaaaaaccatacgccatcattgcattagattgaatcattgcttttccttccaaagggctaataaaaagcggtgaaattcgtcaaatctcaccgcactttttacgtgtctacttggcttctttctcttgctttttcacgccacaacatcaattccgctaaatccatttcatcaaatacagccggcgaccaatgaaaaatagtggcaatatccgcaatagcgtcttctacgcaatgaggaataactaagcctgttgtgtcgccgttgtattctccgtcgtatcgttcgtttccgttttgacgaaaaaaccgattacctccgaacaaagggcggtaaaatcaatcggatcaaggtttaaaatttccattttccctaaagacggttgcgttacacgtggcaacagttggcaataagcgtcaacgtccatttgcattacatcaaacatcttcaagcctttaagggcattaacattcggcttaattaaacgaatttcattgatttccgtttcgccacgttttaacggctgaatcagtgtaacagttttatttttcatctttttttccttacaattcctatacgattataaaccgatggctcggcgatgttcttttaagcgatctacaccattgacaacaaaaacatgattaattaaatcaatttcaatcagcgttttaccgttgacgatttctttgtaatacgtgagtgaagccttaaaggtttcttccgtatcatcgcccactttcgcattacccggatcaatttccgtataacgcccacgcataactaattcaacagcggttacttcgcccgtgtcgtcacgttgataagcctgcgacaaacgcaacagtacgccgccaatttctgccgaaccgaataaagcacgcatattctccatatgcccaccgaattttaattcagcctctaatttttctaagcctaaattaatatcgacttcgcctaacatatcgcctgcacgataactttccgctttaatggcgagtttggggcgagtaacctcgttgacttgtcctaaataactttcgccgtcttggtgtaaattcattaattttaatttattgggtaaagacatagttcatctcctaagcagcagcgactttagatgcaaattcagttaaataacggtcggtaatacgttgacggaaatttaaattttctaacggcggtaccggtgtatagtcatagtcaatatacaaacgccccgcttttaacgtttctttgctattaatctcagcgtcataccaacagctggcgtcaacaagatagcctaatgcgacaagttccctaaatttcgcattcacaccctctataatgtctttcactaaggttggggtcatcggcttatcaattgcccaggcgtgagcctccgcaatcgtatcacgcaaaatttgagcggtacgtgtatagttttcaaactggaataacggatcggcagaacaagtacgagacccccacaaacgataaccattaaaattaatcggtacagtgacgttattttcatttaggtaattggcgtctgtactggtatcttgaatatcaaaggtaatatcacgactcaccccgctcactccctcgacaaccacattagaaatcgttttatgccagcccatagttttatctaaatacgcacgcaatcctaacgcacgagcaaccgcactttcattttcaaccttcttactattaacatcaaaagctaaaaaatcaccatgaataaccataacttcacgctgtccaaatcctttttgatattgaaccgcttgctctttggtttcgcaaccatgagcggatatatacgcaaacgcatttaactttttagcgacgctggctaattctgtggcaacggctttattatccaagtaaggcacacccaaaatacgaggttttacgccgattttactttgggcaactaacaaggctttcatacccgtatactgtcctttttctgttaccgtaccgataatatttgccgtggtttgtgcattatcagtttcagtgtcgctgacgctttcgtcttggacatcgctctcactatcgccaccgcctcttctcgtggctttggttttgctttttttgccttcttctacacgcactacaacagtcaacgtattgacctgatcactaattgcttcaagggttttcgccaacgtacccgtcttgcccgctttagcaatcgcagtcaacggattcgttaataaaacaggggtattaagtggaaacgcttcactatcagcatcatttgcggtacaaacaacaccgataaccgccgttgccacggtttttattgtgcgagtaccttcgttaatctcaataacacgcacaccatgcaaataatccatattaaaatcctttcggttaagttaagggaaatttcagacatcttagnnnnnnnnnnnnnnnnnnnnntattttgcaagctctaaaaagtgcggtctagtgattggaaatgtgaaaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatgaagaaaccgcccttgttgagagcggtaactaaaaggaactggattatgtatcttaagttgttaatcctagttatcttaatcttaataagcacgccagcttattagattagaaagctaaaagccctagcagagaacgccatctctgctaggcagttcctaaatattacaaccacagctattaaaaatcaacaatttataggaaaacactatggctatgacaaaacaagaaattcaagcaaaaagcgatgctaagcgtggtgttcggttgcaatcctacaaacttcacgaagatattattgctctactttctgaactgtcggagcaaacaggactttctaaaacccaaattgtcacacaaggaattaaactgtttgccgaaacaaaaaaggtcgcttagtgtcaaatnnnnnnnnnnnnnnnnnnnnnnnnagccaattgattagggttaaatcgccagcccttttcgcttctgaatatggcattaaaacaccattctgagcaaaaaaatttacttttcttctcacgaaaacccaatactaagccaaacacgccttgccaatcatagttagctccttttgtcttcttaaaataggcttttacttgttcttcggtgagattatcaagcggaattaaatcccatttttctgtcttaagggtcatttctttttttcgcacaccgccatcacgaggacttgaactgtagcaatcgtaggtgatatacggataataatcgccacttaaaaacgccgtttgctcaatggcaatytcacartgrctatattgycccttmgtgatktkrcgrataagycmatcyrtmamtcggtcatagagactaccgcctsksccyttgtamaragcyaaatacaccttactcattgctcaactccttcaaatactccccataactggttgtccacccgctggaataatcatattccgccggattgtccgattgctccatagcggttttatgcttcaaggcattagcatgattacctgttttagcattcattaacgcctgccaaatcagcattaatttttccttatttatcatcaaaaccgagttatccgcacaagtccacgcaatctccatatcaccgaataaatcataactggctttgacggataagatattccgctccgccgtagcgtccgtatcaatccacttgcccaccgcttccacaaacaccccgccattgattttttcatctcgcaaggcattgattttctctcgcatttccgcccgcacttgggttaaatgtgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagattttcatgtgttgtccttggttgttgtttttgctaaaataaacttatatttaacttatattctttattcatgaagtcggttattttccaacccaaagcgttaaagcaattaagaaaaattccaacaggggcgaaaattgcacgaaaatgccaagaattaacgcattttcctttttgttctaatgtaaaagcccttgttaatcatcgttacccctatcgttttagggtcggcgattaccgagttttctttgaaattgccggcgatatgatgaatattatttccattgaagaggtgaaaaaacgagatgaacgcacttactaacattcaatatttacatgatgaaagcggacaccctgcttttgccgtcatgcccatcgctacccttgaatggttaaaacaacaagcaaaactttcctctcctttagatagtggcgtgccttttgctgtggcgacttttgccttagaaaataattgctccgcacttgttgcatggcgtgagcatttaggattaacgcaaaaagacatggcaagccgtttaaatattactcaatctgcatatagtcaatatgaaaaatcatctcacttgcgtaaagccacaagggaaaaatcgcccttgctttaggaattcatgcgacgcaattggatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattacgcaaaaaacggtcttccgctttagggacgttgtctatactggtatatttttcaatcaggtatttatacaactcagggtatttttcttgggttacttcgtctctgattttgtcaaactcaacccaaccatttgggatttcrtctgtcgcaaaatacgccgtcataccgacatctgagcgagttaaattgggtaatctttttttattacctaaagtgcggtataaatcrgggtaggttykytggtyaatwkycgwyccatcgcattttaaaaagccggtgggatttktaayttctttkggaaacgctacaatcgcccccaaaggcacaccatcaccgccgatatctttccattccgtccattttgagccgctaaaaaaccgtgttttgacttttgtatcattggctttgcgtgcaatttgtcgcacggcggtagtttgcccaccgctcaccacttcaacatgccacgctccgttgttatcgggcaaatgctgaccgctcgcaaaataataatgcccgtcggttttgtaattatcgacatcgtccgaacctgttttaacctgaaaatcggtaatgccgtagcctgataaagtggtytstttcgattgtttgctttcagcaagttttcttgcgtcttccgctttgtcgtaggcagttttaaccgcttttgatgtagcgacagtatcggagctactactattcgttaaatccgatttttgggtttttggaatatattcctctagcttttttgctaactctttccccgctttagcggttaaggcgagtgtttcgctgtctgaggttgtctcgttggtcagttgcacaatgccttgttggcttgtactcgctttggttatctcgtgagtatgtccgtcttcatcaattttattttgactgttgccattaatggttttgggttgtagctgtcccgttttcgcaaaaataacgtcattatctatttttaattcaacggcgtctgatgaagataccgccaaaattaagcggataatttggacttttccgctaccgcttgataattggggtttaaaactttcagggcaattggcataagcaaccaatttatcgttattgtcgaataagccaatttctctaatccaaaaaccgccctctgtttcagggatcagtaattcaaagataacttgctgatgatttcttggatctaccgatattgcacttacattattgctataaactttgttttctaattttgttgcgtttttatccggcgttaccgcttgcccgttgccgtcgccgattgccatttttaagagttgtaagggttttttgttggcaatggctgaggtaatgagctgttccccatgttgggttaatacggaataataggtttttgtcatttcttttccttatttggtttaattgggttatttaatttaatcgggttatggataaacactgataatttcgcccatatattgaccaataaaatggtgtaatgggcatttaggcgatatagaaatagctaactgtgttaaatgtcttgataccggctttgcatcatcaacgagacggactacttcattgtaggtttgttcattcaatccgctttcagcgacttcaatcgtaatgctgaatgtgcctggtgtgccttgtgggtgcagatcaaaccattctttgacttccaccaaatagccgataggctcaaccactcgacgaatagcactaatcgtacctttgtatttgtggattaaaaaagcctgttgaatggcaatacgtttgacttgttctgtccaatgctcatcccatctatcaacactgaacgcccacgctaaatacggcaacagctcaacggggcaacgctgaggattgattaagtctgcaataataataggattgcggacagcaaactgtaacacttctgacgctttacgctccagctcgctactgcctaaaggcaatagtgcggggacggttgggaacctgtcatcaataatcatctgctgtcaccaattcaagtgtaattttttcacaaaagccggcttgattattctgtaatacaatatcggcttgaggttgtagtaattctacacgttgcaccccttcaatatgcaaggacgcataaataccggataaggtaatatctcgtcctaatcgctgtttgtcttcggtgtattttttgattttttcctgtgcctgtttgttgatgggttcgtattccggtcctctgtagatgtgcagttttgcatgaatttgataccgatgaatactggcactttgtaccgttactctatccgctattgggcggatattttcatcattcagttttttggtcaccgcatttaaaaccgcctcaccggcttgcccgtccccttttttggctaaaatagtgacagtcacattcgcaggtgagggcgatatcacagagacatcggcaacctccgcatgtgcggataacgcatggaatacataagctgcacgaggtcccgccacagacaacccctcaaacgctaattggcaacgcaaacgtaaatctgtgtcgctttctcgtttttcttctattggcggatttacgctatagtccgctttttgtatgatgagacgctgtacattaaaattagctgctatcacatcaagatcgctccctgttgcataagctaacattgttgcttttgctgcttcgttaatgcgtttgcgttctaataactgcaaataacaattttcttgtaataatttgttaatcggttcactttctaatgcgagtacggtttcccaataggcttgtttttctttagggtagagtgctataaattgagctttgcgttgttttaataactgttcaaaatcaaggtgttctaatacctttggggcgtctaatttcgataaattaactaattcgctcatgccgtttccctaatatgatttgattaaaatttatttttttgttgtcttttttgcggataaagtccatattggcggtgatttgtgctttctccggcacgatatccactttaaaacgtgtaatttcaattctcggctcccattttttcaaggcgatcactgacgccgtggcaagttgtaacatcagggcttttgtgatgggacggtcgatcagctcaaaaatataactgccatactctcggcgttgtattctcgtcccaatcggcgttaataaaatatccgtgatagattgttttaaatgggcgttttcgttttcgcaatatctgcctgtgtgtttatccattagttaggcactcctgtcgttccgccactatctcctgcgtgtgtatgcgtttgtagcgatacaccaccggcggtaacatcgccttgtgcgttaatattgcctttaacacgtattgacccttgtacatcacttgagccttgcacactgcttgaccctttgatattgacgttaccgtctatatgcatatcttgcgtacaatgcactaagggcgtgttaagcgttacgctgacattagcgtcaataagtgcggttttaataccgcttacttttaattcacttgtcgcttggttgtattggataatggcattatccgcaaattgaattacatgctcatcaggcgaattgctcggggtgttaaattccaacgtgtagagggcactcaaaataaaaccgctgtttatttcacccgcaggggaaataagaatacattgttcacccggtgtaatcggcgaccaaattttggttgtaccggcacgtgaagcacaccacggcaaccaatccgttaagatattacctgtttgtactttggcacggcgtttttcgtggttcacttctgccacgacaccataccgcacaatattttctaattttcggttaaattctgcttgcattgcacattcgcacattcttaaataaagtgcattttgagaaatttaaccgtgtttgagtagtatgctgggttgttaagctggaaataacaaaaaataaaatacattaaagggcggatataatccgcccctacwgtaggggcgaatcacattcgcccaatcacattcaccaaacaaaagtaagttgattaattgttattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattcgcccccaattaattaatctctgtctcttaaggcggatcgcatgcgtgcttgtttttgttgttctattcggctaagggctttttctacttctcttgcaatatcttccgcacgttgtcccgccgtggcatgaatattgattgtcacttgcataggttgaggtgtttcttgcaggtgatgtgttgttggacttaagggcggtcgattatccataacaaaaggctgtgcggttgcaacgcttaatcccattccggcggtcaacatggctttttttccgtaatttagggcgtttaataaggggacgccaaggcgtgatgttgcttctttcgtcatgatatattccccgccgtgaaatatgcccataggctgatattttccaccgtttccggcatatccgcctgaccatttattcaccggcggaacgtgattggttgttgtttgtgtggtgaaggtggcttttgtgtcggtgtctatgccgattttttctttaaaccacccccatactgacgaacctacattgctaatagtgtcttttactttgccgagggcgtttactatgcctgaacttaatttttccatcagcaagctaccaacatcagagaaactggcgggcagttcaacaccaaaataatttaacacggcggaaaaagctttgtagaataatccgacaggcgaccaatctataatcaacttgctcacgccgccaattccgccgttaaaggcttctttgatgtgttcccaaatgccacccaaaaactgaaaaataccgttccatacgtggaaaacaatattttttatactttcccatacctcgctacaagccgtttttagccattgccaaccggcaacaaatgcctctgttactttatcccagtttttccaaagtaaatagattgaggcaattaacgcaacaataccggcgataatccaagtaatgggattggttaaaagtgcggctgaaaaggcaataattttagggattatagccaaaaaagatatccccaactttcctaaaaacaggattaatttaccaaagcctaaaatagtacgggcaacaggatagacaatgtagcctaaaaataatgataatgcacctaatgctcctatcaccaccgctattacacttccaacttttactatgtttgcggttaattcttggtttgcatttatccattgattaacgccacgcagcaaatcggttattttccccaaaaactcgcgtaaatcggtagatacaatgtcaaatattgaagttcctatagcttcttttgctgaagacagcgttttaaaatcaccagccacattatccgtcattgtacgactgactttttccgctgtgcctttcgcatctttaagcatattttcatagttttgaattgtgtcttttgcttgtgttaccaattcggaggcaccagctaacccaattttgccaaaaatattatcaaaatattcaaggcgtttagccgttcccattttttcggttttctgcattatctgtttgagaatttcgggaacttgttttaaattacctttggcatctttagtggatacaccaagtttttttaaggctttttccgcttcttttggcggtgcggctaaacgcacaaacatattttttaaagtcgtgccggcttgagaacctttaatccctacatttcccaataaccccgctaacgctgccgcactttcaaaagattgacctgcagcagtcgcaataggtgcaccttctttcatagtctcataaagcgtttcaagagaggtattagaggtagtaaatgtaagtgttaacacatcagcaacaatccccatatcatcagcctgaattttaaaacctgaagatatatcggaagcaatgtccgcaacacgagctaaatccgtacctgatgccatagacatgtttaacatagaagggacggcagatttaatttgcttgtcattaaatccagccatagccaaatagccttgtgcctctgcaacttctgtttgggtaaaagccgtttcagcacctagtttaatagcctgatctcttaatgccttaattcgttccgcatctttgattttatttaatcttgttaaggcttgcaccttagaaaaagccttttcaaattcaatagcaggagaaagaatgctaccggcaaccatacccgtcgaagcagccgtaatcatagactgttgcccatattgttttaaattattacttgtattttttaggacttctatttttttattatatttctcttgcgttttcttttgttgatttaatttttcaagtgcttgagtttgtttttttattgcatgagtggttttctcaattttattttttaatctttcttgagcttgcgttaaccctgttttttttactcgctcttgtgcattttccaatttttttaataggtttttattggctattattgcttgtgaggttgattttacttgctttgatgtattgcgaaaaggagcagtcaatttatcaacggcatttagcaatacttgtatttttaaatttttgttcataaacaatcctttttttcatttattttttattatcaataatcacgatctcgagaacaatttattaatgtgtttaaataagattgacaacgtagaaaaaataaacaaagatacacaaaaaacacaggaggtttttatgcgacacgatgaattaaagtatgaaaattttacttttttttgggttactcatttgtactacatcagtgctatgtttaccgttattgtgttgtttggtatttcgctaaggatgagttgggaaaccttatctgtcagtcattttttcagttccttgcttatttccgtttttttgctttctatccctgtcggtataggttgcgtgttattcacgtttgcattaacgcctttgatgttacttttggatacagtgctaatggcaattcaaaagaaatccggacgttatcatgctaaagaacaggtcgattatcaatttagccttgaatggggcataagtgccatcattcttattgcggttatttgctattttttaatataaaaagacaataacgacaaaaactacggtggttctatgaaaaktaaattgactgttaatrattttattgaccttatttttgtgttaattgtcgcatgtccttaccttatttgttatttttattttgatttaagcgttgggctgacgtttatttttggcagtgttgctttattttttatctttgtgttgttttatgatacgtccaatcgtgataaaaattgttgccactgcaaaaataagaatttagatgatgacatctaatcaatattttcactcaatgcgttgatcacaaacgcttcaatcatttctttgtcccgttccgtaaagccgagcaattcacgcttggcgtattgtactttgtgttctttgtgtcgttctactcttgctcttaatccatattgatgaatagtggcgatgtaggcggtatttccgctaaaccctagttctataccgtctttttggcggcgtagcttcatgtgccttgcttgggtgatttttttaaacatggcttgggttttaattctgcctttttttgaccgcactttttgcttgcgtggttgataggctgaaccgtccggattttgctgtgctttaattcgtttgcgttgactgcgtgcgagttctcgtccgatttgttggtaaagcagttttagccgttttggtgaaacgtttttaagcagacgttcaaaagcggtttttacctgtagcatttcatccatgttgtagctcttttatttttctgtctttttttctatgatttcttggtatttttgtgagcttggttcatctagatgtgtgatgatattttttccgttctcttcttttaccgatattcgttcggtgagttttaggaagatggatagatctatgctgtcgtggttgttgtgatcggcgataaagcggaatccgtcttttcttttgtccggattatggattaaatcaggttggttttctcggataaagtccataatcggggcaaaaatcatattgggcgatccgctaaaatcacgtacgataatatttaaggtgtattgcaattcataggaggaagatgtcgcaccggcactaacgacaaccccttcatcaatgaataattccaatttatcagggttggtattgaggtcttttgaggtgctttgtaacaaactgcggataagctctgcttttaacatgttctcttccttaactgattgacgagtatctataaatacgttggtgtttttcgataatgcgttgacaatctatacaacgacaatagccgttctgttggcgtatctccggtatttcttcttggcaatctagacagtatttcactgtgctttttttccgtgttttttgttggtgtttttggatggcaagttgttgcattatttctgtgtattcgttggctctgtctacgtgatcagtcatgttttttttcctgtaatgtgcggttgtagttttctatgcactgtgtaagtgcttgatttatcagcgtacatttttctatttcattgagtgttttatccaaggcaacgacgagatctccgttattttttagtgttattgtcggtttttggcatagttgatctgtcgggcaaagtagcggtatcggctctattaatctgatgtgttcgttcgttgaacaggcggataatgcgattaggcacaggctgaccgctccagctctcatattgtaacgcttgtttaatttcatcagtccgtttctccgcttggtgtaaatgagttaagaggttgtcattcagtttttttacttgttcttgatagtggttgagttgtttttttgcatgatctaattgagcctttagttgtttggtcgtttccttttcttggttgatgatgttgtttgcgttgatgagcttttgttcttttacttggttgttaaaatacaaatagccgttgatgctgataagtatagcaactgcaacgatgatgactttgtttaatgtggtgtttaaaaataatgcacggttaatcatggtattcacctaaacagagggctttttcttttgctctgcgtgctactaagccgtttaatttttttccgcctgcgtaaatccagcgttcaaactggtgacagagttgaggggtaaagccttggtttgcttgtttaaataaggtgcttttttgcatttttccacatcctacattaaaggtaatggaaacaaaggcatcaaacgccccttgcggtagatttttgccgtttccatagcggtttacacattgttccgctcggcgtaaatcgtttgcccaacgttgggctatttctatgtcgctgtaacgttttttcgggtcaatagtttgtccgtcagccatggtagacccaataccgacagttaacacatcggaagggcagtgataggggtctcttctgcaaccttctacatttcctataaggtctaatccttgttgacttatgcgtaactcttgatggtttgttttgacaagggcaataatggcaactacgctacaaatagcccctgttccccattttgtgaatttattcatggtcgccttcctttaagtcaatcttttgtttgagtgcggtttcttttaatttgatttctttgtttttgtaataccagttaatcagcatggtaaataagccgaataaaataccaaagatagctgcccagtctgccaaggtaaagccgctataaatggcgatggcagatccgacatacgcccctgttgtttcactattttttaacatgttaaacctcatttaatcccataaactcaatgtatttttgttggtggtggtttgtatatcttcactattaggcaagataacgacggtaccaatggcgaggattggtaagttggctaatgttgggtttagctccaatacgtgttctactaagccaagcgttttcccaaaataacgatagacaatgctatctagtgtgtcgttttgttttgcataaaccattcttgccattagattaactctactatcattctgtgttgtcctactatatcgcggatagcaaagcgtccgtcacgtcttaaatcatctacgctttgttcaaagtcctgtgctttttccgccccttgtttggtggtgtcgtatgagcgatagcgttcgtttaaattggctaaggtgaaacaatacaccgctcttttgtagcgttgtattacgatattttcgccgttgattttttcgtcatccatgtcttcaaggcgatgaatgtgtttttcttttagggttttttggtaatgttttaaggcgttgttagcggttgccatggcttcgataacttccattttcaaccgttcattcgttaccgttccgtctattcgcattgcatttcttacatcaagtaaatgaatatcagggaaaaagccgttgttttggattgtttcgttatctgttgcttgttcttccgcctgtcgttttaagtcgtccatggcgtaatttttgacttttttgatggcgatgctgttatgcatgatgttcctttaactgtaaaaaagcgaggtgaggaaagtgatgaggcaaaaaacctttactttccgcctcgcttggcttgggctaggttgctctgtttcgtgttcagcggggattttcttgcgttaattgttttcgcaatttttttacatccccttgaacgccaatatttaaattcagttctaatgccttttccaagtaggctaaggcggtttgcggtgctgatgtgagctttaatagtccgatttctctataaagtctcgctctactttcatccggtatatcttggtcatcagtgaggttcgctactcgttctaaataagccacgtcaaaagggcggttaagtttttgtgcaattttggctttatcggcaaattcttccgctagggcagaacataaggtgcggttaaagttttcgggcaatactaatccttgatgtatagcatagtcggcaatttgtaatgcgaggtgatattgctcacagtctattaaccaaattagccatgtcattaagacgttatcttgtttgccacttgcactacttaacgctccctctatccaaggtaaataatccggtaaaatgttctttttgtagtccgcttttaacgccatagaatgaatttgttttaaatcctttttatggcgtgcaagaagatacaacattctttcgtattccgtcgcttcgctaagtatgcgttcttcttgcatatgtgcctttttcgctgaaacttctagaaaatgccttcttgttggacgcattcacactttccttattcagcttttttcgctttgatgtcttcaggggcatctatcatgttgatattttttaacaatgccacactttcatagttttcgacgacaaagtcatcattagacgaggtgtaatcttcgtagcggtcatattctgcattatcttttaatgttcgacgcattgccccttcttggtaatagattgacaggttatcaagtcgggtaattaagattgtgccttttggtacaaaaggggcttgaacggcttgtaatccgcccactcgttttgtactcataataatatcaccggcaacttgttcactcgccttgctttgattgagcagagggaagtatttatcagccagcaaatcacggctcataatggcgactaatttcgtgtcatcttggaattgaggtgcgattaaatcgctgacggcagaaaacacaagggcatctaaatttttgtatgtttttccttccccgacttcaatttttccgctgctctttttgtcttctgtcatgacacgttcaggtgcattgtcttcaatttttttcaaccagcctacagcgacatcttgcaataatgggtttgtctttctgttagaggttgctgcacgacttgttccgttaaaaccgatcataattctatccagtgccatgcgttcggcttttaatgtgccgatgcgtttagcgaaatcagggaattttgcccacatatccaagatggcatatttgagatgtgtatcatagttaatttgttggcagtgatacggaattttgtttaacgcatgaattgcttgcgttttacgtcctgtcgcattggtatctgttgttcctgcaatggtacctgatacgcctaaccctaagatttcaccttgttgttcatctaccggtacaatgttgatcagttttaggaaatccgagctttcttgtactgcattttcaagacgttgctgtacacttggcgtcacattaaatttcgcccctcttgcaattcttgagaaatcctcttggttatcgtttgaaataccttgaatgtaattcatgaatgtttgtgcggtggtttttttcatcgtgtttaagtcctgataattgattaaaagaaacgtccatcattcatactatcgccactaattaaagggcgttcggtatagttggtatgcggttttttttctaacacggcgaatttttcgcagtgttcgtttgttttttctgtgtattcatttagcgtttgttttagcgtttgattttccgtttcaagtgcggtgcatttttggctgaggttttgcacttcttttgaaagtaacatgaccgcttgatctatatcgttaaaacgttgtttatctgtccgctctttttggctaaacatcgctgtaatgcgttcaaagagagtaggtttttccggctccacgtcgttaaattctaagcagacttctacggcttcagtaaacaaattttccgtttttaatttgcgtgcattaagggggttggcttgtgccgatgaggcaaactgtaacatttccgtccctaaacttgccgggttatccgtgactgcaagacctactaaataggcttttcccgtgtcgctgaaattggtatcgatttcaattgaggtatacactttttgacgttttttgtttaacgcaatgagttcttctgtggggtcaatttgtgctaagagttgtaattttccttcgctttcttgggtttttaaggcgatgacatcaccgtaagcttgagcatgcggttcatcttttcgataaagccatgttttgatatggtctaaattaatacgtgctccataggttttaggattatagctttctgccatttgttcaatccaaactcgtgaaatattacgtccgtctgtggtcgccccctcggttgcaacaacaaaccattttgatttgtattttttcatgggtgtattcctattttttcttttcaatttgtttttatactggttgatttcttttttcttgtcatttgcttatcaatgttaatttttttttgacagtttacaggggtcatgcattttcttggatttccttattatgctgtgagtgagaattaaggatggatagatgattgatataacgttagacagtaagcgtgaaagccgtttgctttatttttcaggttggcggattacggatattgccgacaaattaggggtgcctatttccacgatttcaagttggaaagatagggagaaatgggacgatatagcccctgtcggtcgggttgaaaataccttagaggcgagattgaatttacttattttaaaagaagataaaaccggtcaggattttaaagaaattgatttgctgggtcgtcaaatggaaaaaatggcaagaattaagaaatatgccaacggtggcggtaatgaggttgatttaaaccctataaaagctcaagcgtttacctaggcaaacaaaatagaaatggaaataatggaaaacttataccgagatgtagctaacataccatttgagcacgtgatcgacagatacctaaacgaagtaacatcacaaaaaagtaggagtagagtgtttcgaaataatcacatcatcattgattacttttaccgatattttttattcaccttaactattctacttttcaaaagattgtttataaaagaaagcctgttttcacagactttctatttatctcattagaatattagctcggcactaagtttgaagttacgtcccggggcattgaagcggtttaaacctttgccggtgacgtaatcaattttattgcttgtaccaaattgtctaattgaacgagcagaatcccaagtgacatatttacgattagtgagattataaacaccaaattgtaagatcaaatttttgattggtttggcataagcgattacatcaaccaaagtgtaagcatcacttctccatctaatagagctgtcagtggtaacattagtattaccgatgttggtaggattagttattttttcttcattttgtgtttctctccacgtatcattatatgtatcagatgcttttttagcggcaacacgagttacatataaatccacaccaaatttaccatttgtattatgataacttagcccataaatgcttgtttttggctgaatagcattcattggagcggtaatattaacaaattcctctaggtttgcagggtttaaatactctttaacttttactcgccctttttgcttactaaatttataactaaactcaaattcacttaaggctttatgcaaaatgctcaaatttaaacgagcgttaatctcaatcccactcgatttagcggattctctgtttatattttgtctaatttcatatggagttttaccaccatttgaatttttgtgatatccaatcgttctagcaaaatcaatgaagtttttatatttcgtttcaaaataattgaaggtaataaagccaaaatctttatagaaagttagtgcgatttgattcgttttagctaactctggttttaattgaatattaggtacaacatgcaaggtatctccatatttagggttaaaatcccccattttaaatgcgaaatatatttcatcggatgttggtgctctaaagccttttgagtgtttaaattgtaagcgcataaaatcaaaaggatctgtatttacacccaaagaataagaatgtgctgcaaaacttttttctttaacaaaagcatcaatatttgcctgatgacgagctaatttatttttctctgcgatttttttattttgtacaacagcttcattgtatgctactacagaatcatcatatttacttttttccttattatattcatttactttctgataaccataatccgaaaacttaggttcatctaatttttggggtagctcgactggtttatagggatctttaaaatcatgagcgaatccaccgacaatatcatctggaattttgggggtgacgccggcagtatagctaggctgatatttaatttgatcataacgatagcccaactcgaaactaatacgatcatttaatttaaagtcatctgcaaaataaagagcctttgaagttgctttaacaggaactaagaaagagaaaatattgcttttaccacatagactagaataacttgttttacaattctccggatacaatgcccaccatttgacattgatagctgaatcacccgattgattaaccatttctttttgggatttagacaaagagccaccgtaacttatattgtgatccgttttccctaatgcaagatattttgtgaaatctaaattaaattgtttggtgtttgtgttcaaagagcggtctgtccaaagattttggttaaaacccaaagttgaaggtaaaattaatctatgtgaatctagtcccgagccaccactttttaatatcgctaaattacgctctttatctactttaaatcccaatctttggggcttattgtctttatcaataacggctattgttgagtcaccatctccatctttgtctatggtatcacaactaatgccatcacaagataataaaagaggtgcatttgtttggtgtttcttaatccaattattgttttcctcaagagttaagtcagaataaacttgaccatttgaaattaattgttccgtaattgtttttgcatatatagatatcctacacttatcagggtgttgagaagatttatctttataacaacttgttacactagtagggacatcctttaaaactcttaatttttcatatttctcttttatatcatcaggtatcttctcattccaagtatcaaatacatcttgactaatatattcataataagtgcgttgctgatttgaatatttatatgtaataggatttccatctttatcaactaattcattatttttatcgtatttaattcccaatggatttaatgagccaatacatttatcattcccatcacaataatcttcatttatagctcttgttttaattttttgctcggaataagtaaatttcatcgtatcccataaaggattgctagaataattttcataagagaatgtataattggttcgttttacctgatcattattatgacgatattcaagttcgggaggatcatttgatttttggagaccggttgcttttaatgtataggaaagatctgctcctttagagcgactatcatataaatcggcggcaacagtaaagcgatgattttctgtgggttgaaaagacaattttagtaatgtactgtctaaatgtttgtgataaggatctgctttttctcttcttttaccttgtactgtggcatcaaaatggttataaccatagttctgtagttcatgaccatcacgttttgttttcactaataaggcatcaaaccatttataacgaccggctaaggtcatggaatctatatgttgacgatccgcactgttgtaaccttttgtgtaagaaacataccagtctttctctgtgagaaaatctctggcgtccttcgttttaaaaatgacagcaccgcctaatgcaccactgcccactttgattgaattagctcctttagcaagttgcacttgtttcagcgtttcaacttccgcactatttctcgtattattaaaattaccatagccttcaaataattctttaaagccctgagaactcaacgtttccgcttggtgtaaaccatctatcgtaatggctactcggttttcatcaacacctctcattgcatagccactggtaccaaagcgtcctttctctacagcagtgattcccgtttcataacgcactaaatcacgagcatcctgcacttgttgacgttttagttgttttgcacttttaattgtttcgccgacctttttttgttgtatatcttggtcatctaaatctgatacaactttaatctcacctaactccgtgatagttgagttagtttgagcctgagaagggggggaagtgagccataaacggacaataccattgtggctacgatagagagttttattttatgaggtgcatgaatttcaaacatatttctgccttacattaaaaattaagtattttgatggccttcaaccaaatgaacgaagctcactaaatcttcattacttacttggaaagcttgaccaaaaccttttacaaataaaccttgaatcggtttaaaactaaataaataaaaatccttataagtactaatttcatcaattaatgcaccatggcgttctctaagaacagcaatacttgctttccattcttcggtttcacgttcaatcacacgagatgtggcatcaaaagataaacgacggcgagcaaaaatctcacgacttttactttcgtcttcaataagcattaaggaaactttaggtacttcctgtaaattacgtgcgtgacgggcaatggttgaaataaaaacctgatattctccattagaaatagcgaatggggcatagctcacattaggtgtaccatcttgtccaacggtggctaacataatggttttgctttgtgcctttaattcttgaatttctggacctaatcgattttgtaatacttcttgacggtttgttgctgtcattttgatttcctcgttaattaaataaattgcttaaatttttctacttggtgcgggaataactgacgttgttcatcacgaccaagatagaccttaaaaatggtttgtccgttgttagcaataaaggcaatgttgtaactttctttgcctctaaatggcaaactgacaaatgcgatttgggcaagattgccgagtttcacatgaccatgcagtgtgccttcatcatctttcatgttgaggttataataaccacgaccaaccatacctgtaggaaaacgatctttaatttcaaaaatcgaaccctctttttcaataatggttgtaaaagttccccatttgctaatttcagtcataatttccaccgctctttcagcagagaaaattcgcacaaattcctcaggtaatgcacaaagaatattgccttccggttgctgaaaatgttccgccatctcaagcgtgatagaaagagggttttgagcaatgtaatctgcgatttgctgttttaatgtgtgcatataagttttacttaaattagaaattttatttcataactgataattattcttaattgtatttgaatttatctactttgaaaagaggggagaagtggagttgaatcgataattattataattttttaatttaacgttttttagatacttgaagtctaaaataacaaccttatattacgaaaactgctacaagaattaaaaaattatgggaaagaaaaaacgttcagcaagctccagccgttggttaaatgagcattttaaagatccttttgtgcaaaaggcacataagcaaaaacttcgttcaagagcttattttaaattggacgaaattcagcaatcagatcgtttatttaaacatggtatgacggttgttgatcttggtgctgcaccgggaggttggtcgcaatatgctgttagacaaattggagatctgggtcgagtaattgcttgtgatattttggaaatggatccaatcgtcggtgttgattttttacagggcgatttccgtgatgaaaatgtattacaggctttattggagcgtgtcggtgagaaaaaagtagatgtggttatgtctgatatggcaccaaattttagcggtatgccagcggtagatattcctagagcaatgtatttagttgaacttgcccttgatatgtgtaaacaagtgttagcaacaaatggatgttttgtcgttaaagtttttcaaggagaagggtttgatgactatttaaaggaaattcgatcattatttaacacagttaaagtacgtaaacctgaggcatcacgtggacgatcccgtgaggtatatatcgtagctatgggttatatgggatagaaataactggtctgttgtcttattgataaataatagccaattaatctgataactttaaatccaaatagatttatagtatcttatgaaaaatttttaattactgaaatatggagttcaaaccttgaacgatatggtgaaaaatatagtcctttggatcgtagtcgctgtcgtcatgatgacagcctatcagagttttagcggaaactcatcaaataacgcaattgattacaccacttttattagcgatgtagaaaataaccaagtttcagccactaaatttaatgaggtcggtgaaatttttgtaactaaaaaagatggttcaaaatatacgacagttcttcctacaccgttagaagatcgtaagttattagacgatctgattaaatcaaaggtgaaaattgatggtgctttgcctgagcaacggggatttttatcgcaaattttaatttcttggtttccaatgatcttattaattggcgtttggttcttttttatgcgtcaaatgcaaggcggtggcggcaaagcaatgagttttggtaaaagtcgtgccaaaatgctaacgaaagaacaaattaaaactacttttgccgatgttgcaggctgtgatgaggctaaagaagaagtcggtgaaatcgttgatttcttacgtgatccaagcaaattccaaaagttaggtggtaaaattccaaaaggaattttaatggttggacctcctggtacaggtaaaaccttattagcaaaagctatcgccggtgaagcacaagtaccattttttacgatttcaggatctgatttcgtagaaatgtttgttggtgtaggtgcttcccgtgtccgtgatatgtttgaacaggcgaagaaaaatgcaccttgtttgatttttattgatgagattgatgcggtcggtcgtcaacgtggtgcaggtcttggaggagggcatgatgaacgtgaacaaaccttgaaccaaatgcttgttgagatggatggctttgaaggcaacgaaggtgtgatagtgattgcggcaacgaatcgccctgacgtacttgatcctgcgttgactcgtccaggacgatttgaccgtcaagtcgttgttggattgccggatgtacgtggtcgtgagcatattttaaaagttcatatgcgaaaagtgcctgtggcggatgatgttgatgcaatgacattagctcgtggtacaccgggatattcaggtgcggatttagctaatcttgtgaatgaagccgcactatttgccgcacgtactaataagaaattggttaccatgttagagtttgaaaaagcaaaagataaaatcaatatgggacctgaacgtcgttccatgattatgacagataaagtcaaagaaagtaccgcttatcacgaagcagggcatgcaatcgttggttacttagtacctgaacatgatcccgtacataaagtgactattattcctcgaggacgtgccttaggcgtaactttctttttaccggaaggtgatcaagttagtattagccagaaacaattggaaagtaaactttctactttatatgcgggtcgtttagctgaggagcttatttacggtgaagaaaatatttcaaccggtgcttccaatgacattaaagtggcaaccaacattgctcgtaatatggtaacgcaatggggattttcagataagttgggaccgattttatattcagaagatgaaggcgaagtgtttctaggtcggtcaatggcgaaagctaaacatatgtctgatgaaaccgcacatacgatagatgaagaagtaagatcaatagtgaatcgtaattatcaaagagcaagacaaattctgattgataatatggatattttacatgcaatgaaagatgcgttagtaaaatatgaaactattgaagaagagcaaattaagcaattaatgaatagagaaccggttgtcgctcctgcaggttggactaataatgagtaaaatttatttgtagttttggcaacgcttagtaaaatcttccgactatgttgtaggttctgattttttaataaggaaaaggggttaaacgtcggtaatgtaacagaagtaaccccaaacaattattctttatttttggtagagtatgaatttgggattttgttacgagacggtggaagaacagttaataatattgcaaaaaacataataattggggctatctactatagcccctatttttattgcaatttagataaagtttattttttatcgttactgagttttttattgaaaaataaatgtgattaaaaaatataaagactgagagtatagttatgaaaaaaatttttttaaaagaattacaaatgatttctttagatattttggattattttcatcatatatgtgaagcacataatatacagtattcactgggggggggaactttgattggtgcaattaggcatcaaggttttattccttgggacgatgatattgatgtatatatgctgtggagtgaataccaaaaatttgtctcagtttggaataaattatcacataatttctataaactatctcctattgaaacttttgatggggatgttgtgggggaaatggctaaaatttatgatgagagaacttatttatcagaaaaacatagggcaagtcatatatttatagatatttttattttagattatgtgcctagtgatttaggtattttgtataaatctatgaagaagcatcgtagattaacacttaggtttaagtctttaaggaaacgtttttatcgagctaaagataagagcggttgtaaaaaaatacttggtaaattatcacaaatttattatgaaaaaatgcaagctaatctcagtcgattaagagaaacgtacaatgaaaaaaacagtgataatatcggtctttttttatctgactatgcttgctggaaaaaatcttatatgcctaaagaatattttcggtcgtttaaaaaagttaagtttgagaataaatatttttatgtaacggagtattatcatcagcacttaacagattattacggtgattatatgacattaccgccggaagatgaaagatctcctaagcatggaatagaagtatattggaaagagtgaggttacaaaattttatggcttatttttttatctaaattaacagcaaacaataaaacaatagataacttagagaaacaaaatgttgtaagttagattaattgaaggactgaattttgtatgttaaatagacccagtccttttagtttgatacaaataatatctgtaataaatttctgtaatttttattttttaaagataatgtagatctgaaataacatgtgtaatgctattaaaaggttagtgaggtgatacattttttagttaattgaaaaagtatcactttcgtccattagattttagcccgatttttaggtatagccagtaaaattggtcatgtttcctattattaaaatttcattgaaatactcatcttaacattacgtccaacacctgaaactttttcacttagataagggttgtacttgcgattaaagatattgtctatgcttagagaaagcttcattccgtgtattttcttaggttcccatatggcaaatagatgatgtaatgagtagccgttggatttaggaagtgaccaataccctgcttcaggatcgttatcgataggtgatctatcttggcgacggaaaaactcaccttgccaaccaattgatatattccatttgggtaggtttgtacctaatgtaattattgccttacgaggagggatctctgctatccaakttttgcttctagattaattaaaggatgatctgatatgtaagtccagtctagagcaacactttcatcagtcagtttgcgatataccagtttccttttccaagcaatatcttctccccatttctttatgtcggatatacttggtgagggtaaattatcacgcatagcggcaaatggtgtccaaccagagttattggagcgtacagctgaaagcgtcaattgttgcttatctgaaggataaaaattgacttttaatagatagctattattgtcattttcagagtataagaaacgagaaccatctgggcgttttatgttatgactattacgaacggttgtgtaaaataagccctctagatttttttcttgattgcgtagaaaaattgcaccgctccaaatattctgtttatcattcgtatggtaactatatttagcaaatccaccaacattttgattttcattgagaaagtcgctcggatttttagtcataaattttaaggttccgccaaatccgccattcccatattttgcagaaaagctgcctttatctacttccacccgacgcagtaattccggttctataaatacagatccttgacgatatctttcaaagtttttttgtataccgtctaattcaatacggacatcttcactatcaccaaatccccaatattgatattttgacctcccggtctaggtgaacctgacatattgacaccaggcaaaacattaactaaggctgcggcattgtcagcttgctgtcggtcaatattttttgttaatagtgttgaacgtccgatatcatactgttcattttgaactaagatgacaggaagagcgtcgtattgttgagcgattaatttgcttgtataaaacgtagatgaaagcaatatagtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtatgaaggggggggaatttaacaaatttattgcacatgactatcgtaattaatgtaaataattgggaatataactaattatcattttaatgtaaagatttttatccgagagaataaaaaagaatatgaattgcataaacattcaatatagagttcaaaggtaagctactttgggcgtttttcagtgttttattcattatttttgtatttattctcaaaaatttttttatttttgttcattccaatattccgctataattgaccgcacttttaacttgattgcgtagcagagcaaatgaaattacaagcaaacaataaaactttggatcttactttacctaaaatcatgggaattttaaattttacccctgattcattttctgatagcggacaattcttttctttagataaagccttatttcaagctgaaaaaatgttaaaagctggtgcttcaattattgatattggtggtgaatccacccgtcctaatgcggcagaagtaagtttggagcaagaactggatcgtgttgtgcctttagttgaagctgtaagaaaacggtttgattgttggatttcagtggatacttctaaagctgaagtgatgttggaaagtgctaaagttggtatggatataatcaatgatattcgtgcattacaagaacctaaagccttagaaacggcagtaaaattagggttaccgacttgtattatgcatatgcaaggacaacctcgtaccatgcaacaaaaccctcaatataatgatgtggtgcaagatgtactggaatttttgcaaaatcacaccgcactttgtttacaagcaggcatgaaaaaagaaaatattatttgggatcccggtttaggttttggtaaaactgtgcaacagaattataaattattacagcaagttacccgattttgtcagcaggatattcctgttttagtggggttatcacgtaagtctatgattggtgcggtgttggataaacctgtaggacagagagtaataggaagtgcgacaggtgcattacttgcggcaatgaacggtgcaaaaattttgcgtgtacatgatgttgatgaaacattagatgcattgaaaatttggcaagcaacagaacaggcttagttttaaagagttgttctacaataagttgatttcacagagtgaaggataattttgcttctcttgcgttgatgaataatcaaggaacgaaaaatggcggaacgtaaatattttggaactgatggtgtgcgtggcaaagtaggaagttatcctattactcccgattttgtgcttaaattaggatgggcagcaggtaaagtgctagctacacagggaactggtaaagtcctaattggtaaagatacacgtatttccggatatatgttggaatctgcattagaagccgggttggcagctgcaggattatctgccgcatttaccggaccaatgccaacaccggcaattgcttatttaacacgtacttttcgttcggaggcggggattgttatttctgcttcacataatcctttttatgacaatggaattaagtttttttctgcacaaggtacaaaattacctgatgatgtggaagaagcaatagaggctatgttggaacagcctatggattgtgttgaatcagctaaattggggcgtgcaagccgtattaatgatgcggcaggtcgttatattgagttttgtaaaagtacttttccggcacatttaagtttagataagtataaaatcgtggtggactgtgcaaatggtgcaacttaccatattgcaccgaatgtcatgcgtgaacttggtgcagaagttattgaaattggtacgcaacccgatggtatgaatatcaatgaaaactgcggtgcaacagatatcaaagcattacaaaataaagtattggaaacaaaagctgatatcggtttagcctatgatggcgatggtgatcgcttaattatggttgatcattttggtaataaagttgatggcgatcagatcttgtttattattgctcgtgaggcgttacgttcaggtaacttaaaaggtggcgtggtgggcacgttaatgagcaatatgagcttagagctcgctttaaagcaattgggaattccatttgttcgtgcaaatgtaggtgaccgctatgtgttagaaaaaatgcaagaatataattggattttgggtggtgaaaattcaggtcatattattattgcggataaaaatactaccggagacggtgtgatcgcttccttggcggtattagctgcaatggtgcaacataaattgtctttaaacgaattagcaagtgcggtgaaattatttccacaagtgttaattaatgtacgttttgcaggtggtgcaaatccattggaaagtgatgcagtaaaagcagttgcaacagaggtcgaaaaacaacttgcgggcaagggcagaattttattacgcaaatccggaacggagccattaattagagtgatggtggaatgtgaggatgctgaactggcacagctcagtgcagaaaaaattgctgaggcagttagagctaattaggtgtgataggataatgaaaatatttgtaatgcgacatggcgaagcagaagtgatggctaattcggataaagaacgccgtttaacctctcgaggtcggttgcaagctagcgagcgaggttattggttaaaaacggttattcctgattttgataaggttttggtaagtccttatagaagagcggtagaaagttttgaaaaaatcgatgaggcttatcatcatcaactaagttcaaaacaggaaatttgggaaggtattacaccttatggaagtagtcatttggtgatagattatttatccgtattggcaaataaaggtgttgataaggtcttgattgtttcacatttacctttagtgtgggatattgtcacagaattgtgttctaaacgtagccctatcagtttttatccctctacaattgttggtttacagtgggattgtgagcaaagtgcggtcattacggagataaaatatccggagtagtaatatgcaaaataacgatttcttatccgcctttattttttcaaccagcgttactctgccgacattgttaatgctgatgttgggtgttacgttacgagcaaaacgagtcattgatgatcgtttcagcggacaagcgactaaaattatttttaatattaccctgcctgttttattatttttaagtatttttaaaaatcctgtggattatagccaacaagtgcctcttttattggcaggagtggttggtacattaattttatttgttggcgctgaaatgtttgctgcaaaatttgttacagataaacgtgaaagaggcacttttgtgcaaagtgtttatcgaggtaataacggcattttaggtttagcattttgcattaatgcttatggggatttagcgttggcaccggcgtcaatttatgcggctgcattaacttttttatataatattttaggtgttattacgctaagtcgttctttatccgatggtaaagtcggtgtcaaaaaaattgttttcaatgttttaaaaaatccattaattattggtattttgctcggtattttggcaagttttaatcaggtggtttttccaaaagcaatcttgacgaccgctgattatcttgcgagcatgaccttacctttagcattaatttgtaccggtgccagtattgatgtgaaaggattatttaagattaatgcggtatctttatgggcgagtatcggacgattactggtcgcacctatttttatggtagtgattggcaaagttttaggtatcaccggtatacatttaggtatcgtgttattgatgtcttcaacacctttagcaactgcggcttatgccatgatcagaggaatgggaggcaatgctgtaacagctgcgaatattattgggttgacaacttttggatctatgtttagttctgttacaggtctgttattactgaatcaaataggctggatttaaataattttttcgtttttatttgattttgttattattcggtaacgtttatatcgtgaatttattttttggcaaaatataaccgcactttggacttatctataaaagtgcggtttaaatttataaatcaatgcaacaaatcattcaaacattttccgacaacggcgtattaagtaaaaatatcaacggtttttgtcctcgagttgaacaaacggaaatggcaaaagctgtagctcgggcaattagtcaaaaaagtactttagttgtggaagctggtacaggaacgggaaaaacatttgcgtatttagtcccggcgttattggcaaaaaagaaaacgattatttccacaggttcaaagaatttacaagatcaactttttagtcgagatctccccactataaaaaaagccttgaactatagcggtaaaattgccttattaaaagggcgagccaattatttatgtttggaacgcttggaacaagttattgctcaaggtgttttggggaataaagaagtgttggcggatttggcaaacgtacgtcgctggaataatgcaacaaaaacgggcgatttaactgaatgtgttgaacttgcggaagatagccctattttaccgcaactgaccagtacggcagaaagttgtttaggggcagagtgtcctcattatgcagattgttatattgcccttgcacgcaaaaaagcacttaatgctgatttagttgtagtcaaccatcatttattttttgccgatatagtcgtgaaagaaagtggttttggtgaattaattccgcaagctgaagtgattatttttgatgaagcacatcaacttcccgacattgcaagtcaatatttcggtcaaagcattacttctcgccaattttttgatttatgtaaagatattaatattgtttatcgaactgaaataaaagatatggcacagcttggtgtagcttccgacacgctgttaaaagcggtgcaagactttcgtttattgctgggtgaagggaatttaagaggcaattggcgtgaagttttacgccaaagtgcggtagaaaaatcgttcagtttgttacaagaaaaagtggattttacagcggaagttatcaaattagggttaggacgttcacaaacgttagacagtatttttgagcgtattattcagctgaaagcaatgcttcaacgcttacaagcaacaaatatcgtaggattttgttattggtatgaaaccatgggaaggcaattcggtttacatattacacctttaaccgttgccgataaatttggtgaacaaatgaaagctaaagaagtcgcttggatttttacctcggcaactttagaggtggcaggaacgtttgctcatttctgcaaacgcttaggtattgaaaaggcggaacagcaagttttacccagcccatttaattttaccgaacaagcactattttgtgtacctcgttatttacccgtcaccaatcatcgtaacacattaaatcaattggctgaaatgttattgccggtgattgaaagtaataatggatgttgttttgtcctttgtacttcttatttgatgatgaaaggattagctgagtattttcgtgaacatagtcaattaagtgttctgcttcaaggggaaacttctaaaggaaaactgttagagcaattcattaaagaagatcattctgttttggtggcaacgtcgagtttttgggagggagttgatgtgcgtggaaaagctttatctttagtgattattgataagttaccttttactgcaccggatgaacctttacttaaagcaagaattgaagattgtcgtttacaaggtggagaccctttcaatgatattcaaattccggaagcggtcattgccctgaaacaaggtgttgggcgtttaattcgagatgttactgatcgaggtgcggtgattatttgtgatagtcggttggtttttcgaccttatggtgaactatttttacatagcctgcctaacgcaaaacgtacccgagatttaaacaaggtggtacaatttctggctcaaattaaaaaggagaaataacagaatgatgacaactttattagcacttgatacatcaacagaagcctgttcagtcgcacttttatacaaaggagaagtcacctattttgatgagttggcacaacgcactcatgctaaacgcattttaccaatgatcgatgagattttggtgcagtccggtattcaactaaatcaattagatgccttggtatttgggcgtggaccaggaagttttaccggtgtacgtgttggtgcggggattgtgcaaggcttagcttttggggcggatttgcctgtgattcctatttctaatttaaccgcaatggcacaacaggcttatgagcaatatggagcggaacaagttttgtgtgcaattgatgccagaatgaacgaagtttattttagtcaattacaggcagaaaaagtgcggttggaaaatactgattttgttcaatggcaagagttagtcaacgaacaagtttgttcgccacagcaggccttagctcaattaaaagatatccagattgaagattggaccatggtcggtactggttgggaatatgctgaattcaccgtagcgggattgagtgagaagacgcaaattgatttaccatctgcccgttatatgctttctctagctttgcctttttatcatcaaaaacactggataagtgcggtagaagttgagcctgtttatttgcgtaatgaagtaacttggaagaaacttccaggacgtgaataattcatgatgtgtttatttttctattgctcgtgtacttgctgaattttattttgaagaaaatcttgatttataggggaagattgaaagatgttttattgcattgaggtttttgctaagagaaataaatctgctcaaaataaaaaattgaagtataatgcacccgatttttcacagaaaaatagtaaaaatgatagaaatatcagttaattaaagaggataaataccatgcaaaaaacttggtttcaaaattaccctgagggctcaccgctggaattggacacttcaaaatatgaaagtttgttagacatgcttgataaagctattcgtgagcatcctgatcgtccggcttatgtaaatatggggcaggttttaactttccgtaaattagaagaacgtagtcgagcttttgctgcttatttacaaaatgaactaaaattaaagcgaggtgagcgtgttgctttaatgatgccaaatttattgcaatatcccattgcattatttggaactttgcgtgcaggtttggttgtggtcaatgttaatccactttatacaccgagagaactggagcatcaattacaggatagcggtgcaatagcaattgttgtggtatcaaattttgcgtcaactttagaaaaagtcgtttttaatacgaatatcaagcacgtcatcctcactagaatgggggatcagctctcttttggtaaacgtactttggtcaattttgtagtgaaatatattaagaaattggtgccaaaatataagttaccgagtgcggtaacatttcgtgaagttttggctgtcggtaaaaaccgtcaatatgtacgtccacaagtggaacgcactgacttagcctttttacaatatacaggtggcacaacaggtgtggcaaaaggtgcaatgttgacacatggcaatattattacaaatatttttcaagcggcttggattgcctcaccctttgtaggcgatcataaaaaacagcgtaaagccattatagctttaccgctttatcatatatttgcattaacagcaaactgtttactttttattgaattaggtattaccgcagttttaattactaatcctcgtgatattgacggtttcattaaagaattaaaaaaacatcgttttgtagggataacaggggtgaatactttatttaatgccttgctgaataacgaaaactttaaagaggttgatttttccgcattgaagttgtctgtgggaggcggtatggctatccaacaatctgtagcgactcgttggcatgaattgactggttgcaatattattgaaggctatggaatgacagaatgttcgcctttaattgcagcatgcccaatcaatgtagttaaacataatggaactattggtgttccagtaccgaatacagatattaaaattgtcaaagatgacggttctttagctgaacttgatgaacctggagaactttgggttaaaggtgagcaggtaatgcaagggtattggcaacgtccagaggcaacggaagaagtgttaaaagacggttggctggcaacgggtgatatcgttattatggataaaacttatagtttacgcatagtagatcgtaaaaaagacattattattgtatctggttttaatgtttatccgaatgagattgaagatgttgtaatgcttaatcctaaagtagcggaagttgttgctattggtattccggatgaagtttcaggtgaaaaaatcaaaatttttgttgtgaaaaaagatgatagtttaactcgtgatgaaatacgccagcattgtcgtcaatatcttacagggtacaaaattccgaaatatattgaatttcgtgatgaattaccgaaaagtaatgtaggtaaaattttgcgtcgagtattacgtgatgaagagctggcaaaacatgcgtaaaaataaatatcaagtgggcgattaaacgcccactttttgtgtatcgttttacccacaatgatgtagccatgagaaaggttattgaataatagataattagcaagtatgtccgttttaataaaagaaatccaaaattcaccgcagtttcaattgattactacaaatgatcgtttatatgagatttgccaacaggcacaacaaaaaacggtgattgctttggatactgagtttgttcgcaccaaaagtttttatcccaaactaggattgattcaactttatgacggtgagcaagtgagcttaatagatccttttgagttgagtgatttttctccttttattcaacttttagccaatcaaaaggtcacaaaagtattgcacgcttgcagtgaggatctggaagtttttcaacattattttcagcagttgccaacgccaatgttagatactcaaattatggcggcatttttgcaacatggcaattccattggtttagctacattgctaaaacattatttcaagctggaaatagataaagggatttctcgcactaattggcttgctcgccctttgtctgacgtacaattgcactatgctgctgccgatgtatggtatttattgccattatgtcaacgtatgcaacaaaaattagctcaaacctcttggcaaagtgcggtgcaaaatgattgtgaaaatttgttgaaaaaatatactcagataaaagatagtgacaatgcttatttttctatatccggagcgtggaaattaaactctcaggaattaatgcgtttaaagctgttagcaaaattgagacaagaagaagcgataaagcgtaatcttgcattaaattttgttgttcgtgcagagcatttgattttattagcacaacataatccaaaatatacttcacagctgttatccattggtttatctccgctggaagtgcgtattcatggtaaaaaaatattacaactcttagagaaagcaaacaaagcaccggcgtatgactatccaccaccaattttgcgagtcactgatgatcatcgttatcgtgtagcaattaaattgttacaagcaacgttacgggaaatcactccggcagatttaccgactgaagttttgtcaactaagcgtatgttagatcagctgataaagtggcattggattaaacaagacaatcctcatgatttacctgatttgctttgcggatggcgtagggagtttggattattgttattaaaggctttgcattaattagatgctttcttaaattttttggaacgaactcaagaaatcaaagggtatacaaattgataccctctatatttttagacagggaagaatgttgatctcttccctatatgtcaatctttaatcaagatatttgattactttaattactttatttacccctgaaacatgacgagcgacttctgcagctgcatctgcttgagattgagttaaatttcccattaagaatacttcaccattttcagtaatcactttaatatccgctgatttaatatttgaattgacgaataacttagatttaatttgtgtagtgatccagccatctttactaatttgtccaatagtaattggttgtgcaaggcgtaactcattatatacttcgtcaacaagttccactcctctagctaaattagttgcctgtacttttaaactattattcggaacttgtccgattaataaaattcgggagctataagaaactacattaacacgcccttcagcttttatttgtgcatcttttttaatcgctgacaagactttttcttccaatgtttcatcatcaatttgagtacctactgttctcggatccgttgcaacttttaccgcaactgccgtaccggtagcaataccaatcacagtggctgttgcacaaccttgtaataaaagagctgaactcagcaatagccctaacgttttatttattttcatctgatttctccttgttgaaattttgcctagtttgggttgaaacatggctttttgtcaagaactatgaatgtgaaaataatgaataatcaataagctcacataatgtgttaataattagcagatgattttcaagaatacgactttccttaccggtcggtactgaaatttctaaatcatttgccgttaaaaatccttgtatatgaccgttattttcaccggttaaagcgataatttgtacatctttatttaatgcacattgcaatatatttagcatcgtttcttcattgccgaaaggagaaaaaataattaatagatcaccttgttgtgcaattgcgttaaattgtctttgatacaacatagtatgacaattttcggaaataatggcagaaccgaccgcactatccaaacttaacagaacggaaggaaagctagggcgttccaattcatatctattgagtaaatttgctactaaaaattgtgcattagcataggatctaccatgcccactgacaataattttattacctttcagcaggcaatttacaatatgttgagttgcctctacgatttttgttgcaagtaagctggaggaagaaatttgagtttgaatactttccgtataaatatctttaactttttctaacataatttttattcatcaagaaaattaggtatccattggatatcatttgttgttgctccaaaagcgactagatcgaaacggcagtccgcatcttctaaactggaatcatattgtgctaaccataggttggctgcatcaagccatttttgctgctttttccaatctacactgtcaattgctgaaccgaaaatttgatttttacgctgacgaacctcaacaaaaacgatcgtttgccgatcttgcataatcaaatccaattcaccgcagttaaagcgttggttagcagcaataaaggttaaaccttgtctctctaaaaagaggcgagcctgatattcaaaactcgcaccttgttgacgtttggattgtatcattcttcgttaatcagatagatgctgtcatcttgctcgttaagcggatagatactgccattttgatattggaaccaagtcatatcacgttcaacattacagttagggccggcactgagttttcctgttaacccatcaatggtaaatccgggaatttgacggaattcattaaattgatttattaataaccaagcatcataacccatagcatataaatgcattaatgagtaatcattattggtcattttttcaatttttttatattgttccgattccctatctttgaagaacggaatatcactaaattgcagattattcagaaacaaacgatgttcagggccactgttaggcgaattactacgtgaacttgcataaagttttagggtcggattaatattatccaacactgctttaatttcagctaattgtttgttattagcaataatatacacgccgtcagtactttcacttaaccccgattttaatgcaaaattaatatctgcggtttgattatagaatttaatattggcatcagtacccaatagttgttgccaacgtagagtaaatgccgctgccgtgcgtcgccccagattattttgcggtactaaaacaagtggaatacgtactgtatcattccacattttacttgccgcactttcagcttcatcttcaggcgataatccataataacaaaggtgttcaattgcccgtgcattaggcgtagagttcaacgctaatacatttaaatcttgtaccaaatacggattattgactataacatcaacattttgtttgagtaatggtccgacaagagtgttaattccctgtttttttgcttgattaataatttgttctatagacattttcattgagtcaaatacgtgaacttgaacattgtaattgactttggcatcatcaaacccgtttttgattgtttcaccgataagtcgtgtattgccgcttaaagggagtattagaccgacttgcgttaaagtagtttgttgaaaattggcaagcccttgtaattctgtaggtaataaatgtgctgctgtatgtgttggataataatttttccaagtcagtaatgtttgaattaattgtgcaggttgattaaggttatcattgtatagttgagctaatgttaaccaaccgctcaatgtaatatttccttccgcatcagtattatttagtacttcactatctgtattgcgtagcaatgcccaagtgcggtcattattttgttgttttcgttgaatatcacttaaaaaattatccatttgaattcgagcttttatcgctgaaatattatcatgacgattttctgcaatacgagaaacaatctcataataacgtgatttttgtgaaggactaagtaatgtcaagtgaattaaagataattgatattctgccgtttcatttttgcctttaacagcagaaatatgagcttcaatcagggatttatctagtttttgttcatcatttaaatctatcaattcagcaagatatgcttccgcttgcgggattttattttctgttactaaaactcgagcagctaaaagtttataggtttgtaaatcttgttgattttgtgtttgttcaattttccgaatgtaaaaatcagaacttgcattggcatcattttttaagcttgccgtaaagctactgcctaataaattgacacagcctgctaaaaaaaacataactaaaatcgggagaaagcatttttttaagcgtaaaccttgcattaaaatagataacataaattgctccttgagtatgtgcaatgtaaaatgcacggtgatcttacttatctcaccaattaaaagcaaataaaagaagtgaaaaatgaataattcgacaggaattctatacgttgttgcaacgccaatcggtaatttacaagatattactcaacgtgctttagatgtatttaccaaagttgatttgatcgctgcggaagatacacgtcatagcggtttattactgaatcactacggcattaaaagaaatttttttgcgttacatgatcataatgaacaacaaaaagcagatgtactgattgagaaattacaacaagggttaaatatagcacttatttctgatgctggtacacctttaatcagtgatccggggtttcacgtggtgcgtaaatgtcaccaagcaaatatccgagtagtcccattacctggagcttgtgcggcaataaccgcattatgtgcatcaggcatcgcttccgatcgtttctgcttcgagggatttttacctgccaagagtaaggcaagacgagataaattggcaaacttaacaaatgaagaccgcactttgattttttatgagtcaacgcatcgtattttggattgcttgactgatattgaacttgaattgggagccgatcgttatgtagtgcttgcacgtgaaatcacaaagacttgggaaacaattcggggggatcagattggaaggttgcgtcaatggttacaagaagatcctaatcgaacgaaaggagaaatggtgctaattgttgagggcaaatcaaaaagagaagatgaaacattttcccctcaagcgattaaaacattacaattggttagccaagaattacctttaaagaaagcagcatctattgttgctgaaatttatggctataagaaaaatgcactttaccaatttggtcttatccaaggttactaatataatgaggctataatctcaggtttaatttgggtataatcgccaaactttttaggtctgatttttaaggacaaatatgagtcaatttttttatgttcattcagaaaatccacaatccagactgattaatcaggcagtggagattttacgtcaaggcggcgtaattgtttatccgaccgattccggttatgcactaggttgtatgattggagataagcatgcaatggatcgtattgtgaaaattcgccaactacccgaagggcataattttaccttagtttgtagcgacctgtctgagttatcaacttattcagtagtgaataattcggtatatcgtttgattaaaaataatacaccgggtcgttatacttttattctaagtgcaacaaaagaattaccccgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatccgatccggaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataaattaactttattcattcccattatcatagacgcttgtgaaagcgacagtaaggaaaataaatgaaagtaaataagcaaaaatcccgtccaactaaaccgcactttgcaaagcaggttaccaacgagtctatgcgggataatacgaagcgatttgcaaacaaagaaacagtatctgaacgtaaaagtgcggtaaaaaacactcaaatttctccaacatcaacaaaatcaactcatgctgtcaatcagcaaaaagtcgaaggggaaagactacagaaagtgttggctagagcaggacaagggtcacgtcggacaattgaagcaatgattagtgccaatcgtattagtattgacggaaaaatggcgactttaggtgatcgtgttgatatacattccggcgtaaaaatcagaattgatggacatattgtcaatttaactcaagcacaaaaagaagtatgtcgagttttactctattacaaaccggaaggagaactttgcactcgacatgatccagaaggaagagcaacggtttttgatcgtttaccccgtttaaacggatctcgttggattgcggttggtcgtttggatattaatacatccggactacttttatttacgactgatggtgagttagctaatcgtttaatgcacccacgacacgaagttgaacgagaatatgccgtgcgtgtttttggggaagtagatgatgcaatgattgctcgtttacgtaaaggcgttcaattagaagatgggcctgctaactttaccagtattaaagcaacaggcgggcaaggaatgaaccaatggttcgatgtcaccttgatagaggggcgaaatcgagaggttcgtcgattgtgggaatcacaaggcattcaagtaagtcgtttaattcgtattcgctacggtaatattaaattaacgaaatcgttaccacgtggcggttgggaagaaatggatttaaccaatattaattatttacggaaacttgttgggctaccgcctgaaacagatagcaaaattgatactaaaaaacctcgtcgtataaaaacgggacaaattcgaaaagctgttaaacgctatgctgaattgaataaacgttataagaaataaaaaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacttatttaaaagtgtgaattaactcacaaattttaaattacgtatttgcattatagaacatgattttttacattgcaccttataaaaagtgctataaaaaagtagccaacatattttgctttccgagtagtgcctcttttgaggcactttttttgtgtttgcataaaacaaaaaacctagcaattcaaagattatcgctaggttagataaataaattagttaaacacgccgctgatgccgacacggaaaccgaggcgaccacggctgtcggaggacataccgccggagacagcccatttaccatttgcggaagttctgccgaggtttaaagagaccgcactttcgctgctataatgagcggcaccggcggcataagaccattttcccgggacgaaagggacttctttgaaagccatcgcggcggcgataccggcttttgcgtctttgttgacttcttcaagacgttggttagtggcgtgtaattggcttccgttgacggcatcggttgattgatgagaaagcaaaccggcggcaacattttgaatacggcgttcattgcctttgctgcccacggaaacgacgccttttgcatcaacgccggcgtaattgccgttgactttaccgataccgcccgttgtttcgcctttttctacataagcagaagaatcaccgaggaagacggagttatcaacctcaacattaatattattaccgataacggtagttttagttcctttgtttacaatactactaccaattgagaatgagcgttctttatgtgtttgtacatcgttaccaatacttaaagagcgatctccatacacttttgcttgaggaccgatggcttgtgatctaagtccagcagcatgtgaatcccaacctattgctgtagataattcattgatgcttttagatttataaccaaaagcattactataattgccagaagccgtagcaccttgtccaagagccgaagcaaatttcgcagttgcgtttgcctcatcacctactgctactgcaaactttccttgtgcgttggatttgttacctatagaaaccgcctgtacacctgcatttgcttggtagcccattgcyacggcataagmttgagcttttgctgttttaccaaccgcagttgctccttcatgtgcagcatttgcttcaaagcctacagcgacaccagactcagctactttggcattttttccaacggcaacggatttggtaccatcagtataagttccttctgccttagtaccttcaccaatataaacatgcccattactaacatcaatattactactatttgattgttgagcttgagccatagccgaatgagcagttaaaacaactaccgcagttaaagataaataaaaaattttcacttaaaagaaatccttaaaaaaagagttaacatagaaaaatcataaaaaagctaaccgcactaagakgcgataatttatgacacgccttaaaaagaggtagtggttctaccaaagcgggcgaaattttaagcgggggggggtactgtcaataaaaaaatgaaaaaatgtgaaaaaagataaaaaaagtaaaaaatgaagayaagarkywaaaaagtgagaagtacaagtaaaaaaagtaaaaaaagcccgcactttttaacaaaaagtgcgggttggattgggaaatttygggttatgtagaaagcgagaagctatgatgatagttttggcttgtggcttataagtaacgtttaatctgttaagattttttttaccttctctttcatttggttgaactccaatgatattcattggagagtagttctgaaagttcattgaaagtattttgcgtaaaaaagaggaatgacagccccttaatttagcgaggggaattagtagaataatatcctcccatcgcactgtaaatcgcattttgactttgaattaaactgtatttcgcattcagaatggctaattgagaggtattttctgtattagcggcattaagccattctattaattctgcgataccggcatcatagcggtttttgtaatattgcgtaatacgtttgttgtaacggtaagtctcttgtaaatttgcaacattttcttttgcttgggtataagagaaatagaggttgtctatttcatttagagccttggtgatgttttgttcaaaactcagttttgcattttcataagctgcctcagaaattttaacattccattttactgtattccaatttaagaaaggtaagtttatgcctaccgttcctgtcgcaatcggtatgttgaaagcattgtcaattttattaccgcttgatgataattctgctcccagtgtgattgatggaaaccaacttttttgcattgctttcgcatttttaaatgcactattgaggcgatataaagagcctttaatatccggacgattggcaatggttgataatggaatatccaaatttacctccgcacttttgacttccaagatatttggtgttttgatgtttaaatcttcattcggttttaagttaagcaaattacgcaggatagtttcggcacgttttttttgtgtttgataattaatcagattattacgagccttaagaattgattgttgtgattgatctgtagttgcccgatctgctacaccttgcttgaatttattttgcataattcgactaatttttgagtaataattaatcgtttggtttgttactgcaatggcatcatttaaataggcaagttgatagtaagttgtgacaactgagttgatcagagagagttttgttgcttgtaaatcttgttgcgtagcggaatgtgtccattttgcagcagaggttttatcggctaaacgttgccataaatctagggtgtagctaatattgagtgaaccgccgtgagtaattttagagttgctccctgtgttaatatttttggcagctgaagaattaacgcctgtttggcgtgtgaaatttggtactaaatccgccgcaaccaaattggcattgtacagagccgtgtttactgcaatagtggctttggcaagatctttattattttccaaagcttgtttcaccagttggttaagcggttcgtcattatattgtgtccaccaattttcctgaatgttatattgttgagtcaatgcttcatattgctgaaaatcttgtaatgttgcatggtaactatcatcaatatttgcacaaccgattaatatattagacaccactattgcaaacgtcattttagaaagttttaacataagttttccttatcttgtaagcagaaaagtgcggtctttttttccgcattttctgcaaattttatcatgcttttattcatgtgtcagagaggaaattgagtttaatttagatgcctttttgaaggtatatttactttaaaaaatggcttggtagttcctgatcacatacgattatgtcaaatttatctatcttatcaatataagctttttgaacttgatttatttttgatgaatcaattaccaaaatagcttgctcggttttctccattgctttttgttttgtttttacttcatcaaaattaaagcaagttacgcctttatttacatcaatccctgcagctgagatgaacgcttttgttgtgcaaattgcatccagttcattagttagctgaataggaattaaaaaagagttattctttgaataatttccaccgcacaaaatgacttcacaatgaggtttatcctgtagcaccataaaggtattaattgaacagcaaagtgcggtgaatttaatggcaggatcgatttgtgaggcgacgaaaggaattgttgaaccacagtcaaaaaaacacacatcgccgtctttaatgaaattagccgcaatgcgacccacttccattttttcggcaatatgctttgtttcttgctcaaaaatttggtagctgttatcggtgtttttttgtggatttttgacaatatagccaccaagtaaaacaactgagcctgtatctgaagccaaatcacggcgaattgtcatttccgatacatttaaaatagtggcggcatcacgcaagtgaattttatccatttgtttgagcaaaaagtctaatttttgaatgcgtgattgtattttcttatccataacaggctctattaattaaaacggttaataaatagcgttattgtctgttaaaccgttaataatagcaatccctgaacttgatccaattcttgtcgcaccatttttaatcatttcaattgcggttttagtatcacgcacaccacctgaagctttgacaccgatattttctccaaccacttgacgcattagtgcgatattttcaaccgttgcaccgcctttattgaaaccggttgatgttttaacaaatccgacccccagctcacgacaaatcttacaagcagtgataatttcctctttggttaacaagcaagtttccaaaataactttaagtaaagcaccttcacaagcagctaaaacagcttgaatgtctgcttttacggattcccactgatttgatttaatccaaccaatgttaatcaccatgtctatttccgtagcaccggcttttattgcttctttagcttcaaaagcttttacagtagataaattagcacctaatggaaatccaactactgtgcatattttaacatttgtattttgtaatttttgtcttgctagcggaatataacctgaattaatacaaacagaaaaaaaattatgttcaatcgcttcgttacaaagatctagtatatcctgttctgttttctccgcagttaatgctgtatggtcaatgaattgagcaatgtcataagattgcataaatatcctccttattttaggtttatgtgattattttcacttttttatatgatactgcaaaaaaaattaaaaactgtgactttgatcacttttttaacatttttaattttatatactgaataaaatgaattttgtgagaattataacatttattacggagaaaaacattatggatattgcagtcattggctcaaatatggtggatttaattagctatattaatgatatgccgaaaatgggtgaaacgctagaagctcatgattttaaaatgggttgtggcggaaagggagcaaatcaagctattgcagccgctaaattaggtgcatcagtaatgatgatgactaaggttggtgatgatgtatttgcagataatactattaataatttcaagcaatatggtgtgaataccgattttgtcgaaaaagtggtgggtgtatcgagtggtgtagcccctatttttgttgatcgttcttcacaaaatcgcattttaattattaaaggtgcgaattcttacttgaaaccggcagatattgatcacgctgaagttcagttgaaaaactgcaagctgcttattttacaactggaaattcctttagaaacagtttattacgcaattgattttgccaataaacatcaaattccagtcattcttaatcctgctcctgcaagtaaggaattagacattagttatgcttgtaaatgtgatttctttatgccgaatgaaactgaattggaaattctaaccggtatgccagttgataatatggaacagattcaagcagcagctaatagcttatttttgaaaggattaaaaaatctgattgtgactttaggcgaaaaaggatcggtttggtttcatcgggatcaggtaacacatgtctcctcgcacaaagttaatgctattgatactagtggtgctggagatgctttcattggttgttttgcacatttttatatacaaactaatgatgtcaaacaagcaatgcaaatggcatcagcctattcagcctatagtgtaaccggacaaggtacgcaatcttcttatccggataaagcacaattcgaacaatttctacaatcgttaaaataaggagtatggtatgaaaaatattcaacaaatgcccgatggttatctcaataaaacacctattttccaatttattttgctttcttgtttattcccactttggggagcagcagccagcttaaatgatattttaatcactcagtttaaaagtgtatttacgctgagtgattttgccagtgctttagtacaaagtgcattttatggaggatattttttaattgcgatacctgcatcattggtgatcaaaaaaaccagctataaaattgctattttaattggcttaatgctatatatcggtggttgttcgctattctatccagcctcgcatatggcaacatacacaatgtttttagtggctattttctctattgcgattgggttaagtttcttggaaacctctgcgaatacttatagttcaatgattggacataaagatcatgcaacgttgagattaaatataagccagactttctatccagttggtgctatttcaggtattttattaggtaaatacctcatcttccaagaaggtgccagtcttgaagaacgaatggtaggaatgacaccggaacagttgcattcatttaaattatcaatgttagaacatacgttgtcaccatataaatacttaatcttcatattgattgcggttacttttttattcgtaattacctcttttcctaaatgtaaagcagttacacaaacaggtaaatcagaagtgaaatttaccgatacgctaaaatatctagcaagcaatacaaaatttaaaaagggaattgttgctcaatttctctacgttggtatgcaagttgccgtatggtcatttactattcgtttggcactcaatttaagtgatatgaatgaacgtgaagcctcaaattttatgatttatagctttattggattctttattggcaaatttgtcgctaatttcttaatgactaaatttaagtcagatctcgttttactttggtattccattttaggtgtgatcactctagcttatacctcttttgttcatgatttttctgctgtttatgcggctattttcgccagtttgttgtttggtccttgctgggcaacaatctatgcctcagtactggatactgttaatcaagagcatagagaagtgggtggggctgttgtcgtcatgtctattatcggtgccgctgttgttcctgcaattcacggttatgtctcagatacattaggatctcttcaacttgcatttattgtacctttattctgttttgcttatgttggctattatttttatggaaaattaaaagaaaacaaggagaaatagtatgaaaagctacctttatttatctaaatcacaatttacagataaagaacaacttatttttaaaaatgaaaagctaagtgcggtcgcatttcaatatcaatccggtattgaggcggtcaaactgatcaatagtaaaggttttgtaattgttttacctttttatgggcaaatcatttgggacgttcaatttaacggacaaactctcacgatgaaaaatatgttcaacgaacctaagcggggaacaactattattgatacctacgggtgttttgctttccattcaggcttaattcgtaatggttgcccaagtccaaaagacgagcatcctttgcatggtgaaatgccttgtgccgtaatggataaggcttggttgattattgaagatgacaaattagggattggtggtgaagttgaatatgtgaaaggtttcggtgagcattattcagctagaccggaggtgatattatctgctgacagtacattatttaatatcaatatggcagtgacaaaccttgccagtgttgatatgccgttacagtatatgtgtcatatgaattattgctatgaacatggtgcaacattcagccaaaatatccctgaaagtgcggtgcaattacgccaaactattccggctcatgtgaaaccgacaccgcaatggctatcgtttaatgaggagattaagaaagggaattatacactgtcatcgttggaaaatgatgaaatgtataatccggagatagtgttttttatggataatttgcaacaatatcagtcacaacttgaatatcgtatgcactccccgaaaggtcataattatttggtaaaattctcgtcagcacaattcaattatgcaacacgctggattttatataatgccgatcagcaagtgggtgcttttgtcttaccagcaacctgtcgtccggaaggatttttggcagctcaaaataatggctcattaattatgctaaaaccaaaagaaatgcggtattttagtgtcataacaggtattgaataacatatagcaaacaacataaatgcggttgacaaaagtttaacggtattgctaaatgcatatttagttaaaatatcctaatgaaatgtttaaaaaaattggcttttataaaaatctcttgtataatcgccggaccctgtgaatgtgtcggatttcccaccgcacattattttatcaagatcacactcgaaggggtggagattaagattgatggttgtgcttaagtttaataagcactgggtattaatattattttattggtaattaattaatgaaaacttttgtagcaaaaccggaaacggttaaacgtgactggtatgtagtggatgcgacaggtaaaactttaggtcgcttagcgactgagttagctcgtcgccttcgtggtaaacataaagctgagtatactccgcatgttgatacgggtgattatatcgttgttatcaatgcagaaaaagttgcagtaacaggtaataaagaaactgataaactttactactggcatactggctatgtaggtggtattaaacaagcgactttcaaagaaatgattgcacgccgtccggaagcagtgattgaaattgcagttaagggtatgttgccaaagggtccgttaggtcgagcaatgttccgtaaattaaaagtgtatgcaggttcagaacataaccatgcagcacaacaaccacaagttctagatatttaatcacgaggttaggaaaatggcagagaatcaaaactacggcacaggtcgccgcaaaagctcttcagctcgtgtatttatcaaaccgggcagtggtaaaattgttatcaaccaacgtgagttggacgtatatttcggtcgtgaaacatctcgtatgatcgtacgccaaccgttagaattggttgaattaactgataaattagatttatatgtcacagttaaaggtggtggtatttccggtcaagcgggtgcaatccgccatggtataactcgtgcattaattgagtatgatgaaacactacgtcctgcattgcgtgcggctggttttgttactcgtgatgctcgccgtgttgaacgtaagaaaatcggcttacacaaagcacgtcgccgtccacaatactcaaaacgttaattttatatacaaaattgcaagccaaatggcttgcaattttttttcttattttgtcagtaaattatgatggaggcttatgcattgccttttcatttatggtaaaatgaaaagtctttattaattttcaagtcgtcggaggaaaagatgacaagtgctgcgaataaacgttcaataatgactctttttttagataaggttgatatttattgccatcaggttcgtattgttttagctgaaaaaggtgttgcttatgcaacagaaatagttgattctgaatctatatcagaagatttaatggaattaaatccctatggcacaattcctactttggttgatcgtgatttagttttattcaactctcgtatcattatggaatatttagatgagcgttttccgcaccctccattgatgccggtttatccggtttctcgtggtaaaagccgtttattaatgttacgtattgaacaagattggtatcctgtattagaaaaagcagaaaaaggttcagagagtgaaagagctattgcattgaaacaattaaaagaagaaatcttggcaatagcacctgtatttagccagtcactttattttatgagcgaagaattcagtttagttgattgctatattgcgccgttattatggcgaatgcagcaacttggtgttgtatttacaggcacaggcagtaaagcgattaaatcttatatggagcgagtgtttcaacgtgattcatttttacaatctgttggtgaaatgacacctaaaaatttaatggaggataaataggattaatatgtcgtataaatttttacctaaacgtccctatttattaagagcctattatgattggttgattgataacgacttaactccttatcttgttgtaaatgcaacttattcaggcgtaaaggttcctgttgagtatgtcaaagatggtcaaattgttttgaatttatctgcaaatgcgacaggtaatttattgctgaataatgaggcgattcagtttagtgctcgttttcagggggtatctagagatatttatattcctatgggagcggcattagctatttatgcacgagaaaatggtgatggagtcatgtttgaaccggaagcattttatgatgaattaaatattgacagtgttgatgaacagcctttaggttttgctgaagcagttgatcaaaagaaagtgaaaaagactgaaacaaaaaaccaaaaaggaacatcacatttgcgtattgtgaaataaactaaagcaattttttgaaccgcacttaaagtgcggtttttttatgaaaagtaatttaatcaattcttgtatttagaaatttgcattacgaggtgtgcgagggaatggaattacgtcacgaatattttgcacgcctgtaacataaacaattaaacgctcaaaacctaatccaaaacctgcatgtggaactgttccataacggcgtaaatcacgataccaccaataatcttcagcttttagtcccatttctgctatgcgtttgtcaagcacttctaaacgttcttcgcgttgagaacctccgataatttcaccaattccgggggccagaacatccattgcagcgactgttttaccatcatcattcaaacgcatatagaaagcttttatatctttaggatagtttttaactacaaccggcgatttgaagtattcttcggctaaataacgctcatgctcagaagataaatcaattccccaagatacaggaaattcaaacgctttgccggattttaacagaatatcaatcgcatcagtatagtctatttgagcaaagtctgaattgatgaaatcttttaagcgagtaatcacgtttttatcaacatgcttttcaaagaattttaagtcatcttcacgttcatttaatactgcacggaaaacatatttcagcatatcttctgctaattttgcattgtcagctaaagttgcaaaagcaatctcaggttcaaccatccaaaattcagctaaatgacgcgttgtatttgaattttctgcacggaatgtcggaccaaaagtatagattttgcttaatgcacaagcataactttcaccatttaattgacccgataccgttagaaaagactctttaccaaaaaaatcttggctaaaatcaaccgcacctttatctgtgcgaggcagattttctaggtccaaagttgatacacggaacatctcaccggcaccttcagtatcagaagctgtgatcaatggtgttgctacccagtagaaaccttgttcatggaaaaaacgatgaatagcttgagctaagcaatgacgaacacgagctactgcaccaatgatattagtgcgtggacgcaagtgtgccacttcacgtaaatattcgatactatggcgttttgcagacattggataagtttcaggatcatcaacccaaccggaaacttcaattttgtcggcttgtaattcaacagcttgtccttcagcaggagactcgacaatttttccagtgacaacaacggaacaaccggtagttaaacgtaaaatttccgtttcatagttttcaatatcattatttacaatagcttggataggatcaaagcaagaaccatcgtaaatagctaagaaagatagtcctgctttagaatcccggcgagtgcgaatccaaccacgtactgttacagtttcaccgaccgtgatttttccttttagaatattagccacagatgcaatttttgtcatataaacctcaaatcagtttttataattgtaaaacttagtcattttaccgtaactcattaaaattaccaaaatgtatcggaactttttgtttttgtgagatagcacacataatttatataagtcccttgtttattaggaaaatttcttggtataaatgaacaattttatgaattaaaataatcaggtagaacaggtagaaaatatggcaaaagtgagaaaagaggataaattacctctgagaatgaagcagctaggcaaaatttatcgcttaattgaacaatttgaagaaatttcacgtattgatttatccaagttatctcaactggctcctgcaactatcacctccttaactagagaacttatagaaaaaaaattggtgattgaaagagcggtacaaaatacggaaaatcgtggtcgtccggcagttggattatgtgtctcaccattttactggcaatctctttgtgcaacactgacatacgatcattttgatattttgctatgtgagctggatggcacaacaatagcccaagaagtttatcctcttgatctttctgatttatcttcattagaacaaatgttgccttgctattttgaagattttttatcaaaagttgggactaaattgagtcgtccgattactttttctattgcagtggcgggtaaactacaccatttgtctggttttctgcaacgtttgggggagatcgaattaaatgtggatctaacatctttatttgcaggctattttgatataccgattattgtaacggaatattttgaaacttggttattagcggaaagcacattaggaagcgtaataggatatgatgatgtgattttcttgcaaattgatgaagtcattaatttgagtgttttatcaaaaggggttattctacagagtgatcataaaacttgtatgaatattgaccaaatcattgttcctcgcctgtatccaatgcaagataagatcaatcaacatttatttgagcttgagcgatatcaaatacataatcaattgacttataaagcattttgtcaatttatagatctgtattatccaaataataatttaattaacacgacagaaaagatcaattttttatgtaaaaaagcacagcttcaagatcctttagcattagaaattttagctaacatagccgatattattgcatacatcttatccaatttagttaatcttttttcacctgagaaaattatgtttacttctcgtttgctatccgtcaaacatgttttccttaatcaaataaatcagcgtttagcacattatttgcataattcaaaaatatgtgaagtaatgacgagccagtatgaatggaatagtcatgaagttattgctgctgctattaaacaaaagatttatgatggtagtttgttagtttatatggaaaaatattaaaatttttttcacttagctgtcaaaaaggcgttagaaagcatttttgattgcttgactataaataaaggtttcagctgaaagtatcatagcaagacttttaacttttaagagttaaaggcttttggggtagcgaatttacgcccccagctcttttgaaatggattgtgctgtttgtttgagatgcatgagcaatatatctttgccgatttggtttaaacgtgcagttgatagagaaattgatacggagtagattacattgctattgatgtcaaatattgggcaagctaaacaagttacgcctgtttcattttcttcattatctacggcataccctaattctcgaatcttatttaactccagctccatagcactcagtgttacaattgtattagctgttaattttgtaatattcgtttgatttttctcccaataatcatctagaatgtgtcttttttcgtatgccataaaaatttttcccatagctgaacaataaagttctaaacgctgaccaatatacgctcgtgtacgcatcatacctgttgttggttcaagtttataaatcattacagcatgatgatgatcacgcatagataaattgactgtttcacctgtattcaaattaagttgctctaagtaaggggatgtaatatttaatatattaagtgaactcaaggttttttgcccaatcgttaaacacttcattgttaaacgatatgtaccaattgtattggtaggtttgacataaccacaggtttgtagtgtttgtagcatacgatatgttgtacttttatttagattagataattcagatagtttagctaatggacaaccattagggaaattgctcaaaatatcaattagtaataaacccttaattaaactttggttgctgctagcttgtttatttttattctcttctttcattttttattcctaaatagcttttttggttagttttattttagtgatatatcgataaaataaaaatgagatcttgatcacaaaaaataaaaaaatttatatctatatgatttataaaaacttttatttcttattttcatttgcatacaaattttattcagactataattttttaaaatatcgtttcaatatatgaaataaagattggcgtaatgaggttaaaacatgaaagtcagctacgaaatactcaaacaagaatttaaacgtatattacttgcaagaaatgttcgtgaagacattgctgaagaatgtgcgactatatttgcagatacaactgagtcaggagtatattctcatggggtgaaccggtttcctcgttttatttctcaactggaaaaaggagatattgtaccggaagcgattccgactaaagttctttctttaggtgcgattgaacaatgggatgctcatcaagcgattggtaatatcacggcaaaaaaaatgatggatcgagccatggaaattgcggatcaatttggcattggcgttgtagctcttaaaaatgcaaaccattggatgcgaggcggtgactacggttggcaagcagctgaaaaaggttatataggaatttgctggactaattcaattgcagtcatgccgccatggggagcaaaagaatgtcgtattggtactaatccattgattattgctgtaccgaccaaccctataacaatggttgatatgtcttgttctatgtattcttacggtatgttagaagttcatcgtttagcgggtcaacaaacatttgttgatgccggatttgatgatgaaggtaatttaactcgtgatcccggtactgttgaaaaaaatcgtcgcttattacctatgggattttggaaaggatcaggtttatctattgttctagatatgattgcaaccatactatctaatggtttatctgttgcagaagttaccgaagaaaaagatgatgaatattgtgtttcacaaatcttcattgctattgaagtagatcgtttaattgatggtaaaacaaaagatgagaaacttaataaaatcatggactatgtgaaaacagctgaacgagtagatgctgatgttgcaatacgcctaccgggtcataaatttgcggcagttcgtgctgaaaataaaattcatggtattccggtcgatgattctgtttgggaaaaaattaaatccctataacctataaggaatacttgttctttggtcattgttttgatcaataatcaactaaacccgtaaagtggttattaaaattacggtaaatgtgaattagaggtagcatgatgacatcgattagtttaaccgtaactaaactattagaagcattggttgttattattttagcaacgatgtcttgcttggtattccttaatgtcgtactacgctatggctttaatagcagtatcaatattacagaagaagtttcacgctacttatttgtttggttggcatttcttggtgctatcttagcctttaacgaaaatcgtcatgttaatgttacgatttttatcgagcgtttatctcagcatcagcgaaattttctacgcttattaacggacagcctaatgttgttttgctgttatcttttaattacaggtggctggatacaatttcagcttaatctaactaatatggcacccatttctggtatcccaacaggtattacttatttagctagttttattacaggcttagttattgccatactacttatcattcgacttttttctaatgctggtgctttgataaaaggagaaaacaaatgacggttattatctttctttccactttattaggaggtattttattaggtattcctgtcgccttttctctgttattgtgcggtatagcattaatgttgtatttagacttatttgatgcacaaattttggcacaacaaatcgtgagtggtgcagatagtttctctttaatggcaattccattctttatcttagctggtgaaattatgaatgaagggggattatcaaaacggattattgatttgccgatgaaattagtaggacataaacgtggaggattaggttttgttgcaattcttgctgcgatgattatggcgagtttgtcaggttcggctgttgcggataccgctgcggtggcagcgatgctattacctatgatgaaaacaacaggttatccgttggatcgttcggctggtttgattggtacggctggtattattgcacctattatcccgccttctattccgtttattatctttggagtctctagtggtgtgtctattactaagctgtttctagcaggaatcgtaccgggaatcctaatgggaatttgtttagctgtcctatggtggtggcaagcaaagcaccttcgcttaatgactttttccaaggcaagaaaagaagaactttgtgtttcctttaaaaatagtatttgggcattaatgttacctgtaatcattattggtggtttccgttctggtatttttaccccaacagaagcaggtgctgttgcagcattttatgcattatttgtcgcactctttgtatataaggaattgaaaatcaagcaactttatcaagtttttctcgcggcggcaaaaacaactgcggtagttatgtttctcgttgccgctgctcaagttacaggttggttaatcacgattgctgaattaccacatatgatgacagcattgttagagccactaattgatacaccaactttattacttattgtcgtaatgctatttgtttttttgattggtatggtgatggatcttacgcctactgtattaattctcacaccggtattaatgccattggttgaggaagcaggaattaaccctatctattttggtgtgctctttattttgaatacttcaattggtttaattacgccaccggtaggtaatgtccttaatgtcattacaggtgtatctaaattgccatttgatcaagtgacaaagggcatacttccttatttattgatgatgattgtgttgctctttatctttattttcttccctgctttaattttaatgccacttaattggttacaactttaaatcttcataggagaacattatgacactattaaattttaaaacgctttctgtgttaatcgctagcatagctctattctcaggtaataccaatgctgcaacgacattacgttttggttatgaagctcctcgtggtgatacacaacatgaagcagcgaagaaatttaatgaccttttaaaggaaaaaacaaaaggagaaattaagttaacactttttccagacagtacgttaggtaacgcacaaactatgatcagtgctgtacgtggtggaacgattgacttggaaatgtcaggttctccaaatttttctggattagtaccaaaattaaatgtgattgatattccattcattttccaaaaccgcgagcatgtatatgccgtattggatagtgaaattggtcaaagtttattaaaagaattagaagccaaaggattaaaaggtttagctttttgggaagtaggatttcgatcttttactaactcaaaacatcctgtaaaatcccctgatgatattaaagggttaaaagtgcggacgaaccaaaatccaatgtatattcaagcattttcaatcttaggggcaaatccagttccaatgccattatccgaactttataccgcacttgaaacacgtgcggtagatgctcaagaacatcctgttggtatagtttggtctgctaaattatatgaggtgcaaaaatacttaagcttaactaaccatggttatacgccattgattgttgttatgaacaaagccaaattcgatgctctgtctccggcattgcaaacagcattagtcgaagctgcacaagaagcaggtgcttatcaacgccagcttaaccttagaaatgaaaaaagcattattgaaaaaatgcaaaaagcgggcgttgaaattattgagcgtgttgataccggaccgtttagggctgccattgaaaacgaagtacgcaaggcattcattgagaaaaatggtgatgatttagttaaaaaaattgatgcattagcaaaataagtatattcaatgataagaaacagaatttttattaaattgaccgcacttttacttattccttattcggaaggaggagcttatgttggcaaatggagacgttccaattcttcagctacagcatatcatcaaacgattcggtaatcaggtagcggtaaatgatgttagccttaatattcaccggggagaaattgttgcattgctcggtgagaatggtgcgggcaaatccactttaattaaaattctggcaggtctctattctcgtgatgaaggtgaaatttattttcatcaacaaaaaatccaatcggcacaatctcttaccaataaaaataaacaacctattgcttttattcatcaagatttagggctggttgaatggatgacgattgctgaaaatatggcatttgtaatgggatttcctcgccgtttcggcttgattgattggaaaaaaattaatcaacaagcacaagaagcattggattttgttggtattcacctttctgctcaaactcgagtttttgacttaagtcgtacagaaaaagcgttattgaccattgctcgtgcgattgctgtcaatgctgagattttagtgttggatgaaccaactgcctctctacctgcaagtgatgttgaacatttattcaaggtgcttaatcgcctacgtaaacagggcgttggtatgatttatgtcactcaccgattggatgaggtcattaggctttctgatcgcattttagtcatgcgtgatggttattctgtggcagaaggttcgactaaagattatgatgtgaaagctctagtgaaggctattgttggtgaagaaacaagagaaaaacaacgtgaaccattgcctaaaaacacaccagaagtggtacggcttaacgaagttgttgttggtgataccggtcctgtttcctttagtttacatcagggcgaaatgattgcattagcaggattgcgaggtgcggggcaagaagagataggacgattattatttggactacgtaagttggaaagtggagacattagtttaaatgaatgtgcttatcatgccgagtcgccatgtgaggcaatttataaaggtgtagcacttgttgccggagaccgtatccgagaaggtcttgtcatgtcaatgacaaccatggaaaatctctttatcaatcctatcttaagcggtcattttccattaaaaaattatgcaagcaaaaaagaaaggtctgaatgttggtatcaattccagctctttgatattcggccgaaaaatttatttattgaggtcagttcgctttcaggaggtaatcaacagaaaattgtgcttgcacgttggatgcagctcaatacacctgtgctgattttagaagatccaactgcgggtgtagacgttggtgcacgagcagaaatttatgacttattaaatcaagccttgaaaaaaggtgttgcaattattgtgatttcaaacgattttgaagaaattgcacatctttgtaatcgagccttggtattcaaccgaggcgatatcgtgggtgaattattcaacgaacaagtcacatttgcgaatttgctggcactcgcttcggacgcatctgctaccataaattaattttcgtgtttttagaccgcacttaaacaataggagagcatcatggctcaaacaaatattaaatcaaccgctttagaacagcctgtatctattgcacgtgatgggttttgggcgtgggtttctcaaatgatcactcgatatgggttactctgcttatgttttttacttatcatacttttctctatgacaacagattcttttgcctctatgctaaccttacatgcgattttagaaagtaaatcaaaaattgcactactggcactcgcagcgacgacgaccatgattgtaggcaaaattgacttaaatgtaggctttggtattgttctttggcatattttagctattacactacaagttcaattcggtttttcatggcaaatggcgactatcacagtactcattgtggcagcaatttatggcttacttaatgggattttagttgcacttgctgacattgatagcttcgttgctacattgggaacgggaacggtattgtatgcaattgctttatggcattcaggcggtcgccaaattgtcggtgatttacctgatgcttttattgctattaacagtactgagatcttaggtattcctatctcggctttttatgtgttaatcgttgctattgtcatgtggctggtgactgaacacaccccaacaggacgttgtatgtatgctgtaggaggaaatcctaccgccgcttatttgaatggtatttcgattaagaaatatacgattgtgccatttattgtatctagtttaatcacagggtttaccggagttctcatcgcagcacaacagggtgttgggcaagcaagtgtcggaatggattatcttttacccgcactggtaggtgcgttcttaggcagcacaacaattaaaccgggtcggattaatgtttggggaacccttgttggaattgctattctcgctattggtatttccggtattcaacaattcggtggtgccttttgggtcgagccattatttaatggtgcaactttattattatctatcactatcgcaggttatgcacaacgtaaacgtttattaggtcaaaaagcagtacacaagaaagcagcaacaaaataatttgttgtgttaattacccactaaaaggagaaaatttatgaaacagttttttcattgtagtttaagtgtagtggcttctgtagtcgcactctcttttgccggcaacactatggcaaatgatccatttgtcgctgaagcaaaacaacaagttgctacagctactgctcaaaaaacaacttgggatggaccaacaacaggtccaaaagtacaacaaggaaaaaatattattttcattgcttctgatatgaaaaatggcggtgtattaggtgtaattgatggtatgaaagaggcaactggtgtagttgattggaaattagaggtacttgatggtgcgggatcagtcaataatcaactttctgctttaaaccaagcgattgctcgtaaacctgatgccattgtcattggtgggtggaatccaaatgtggcaaaaattccacttagtaaggcaactaaaaatggaatcacattggttgcatggcatgctacaccggaaccggggccaataaataaatataatattttctataatgtcacctctgattctgaccaaattgctaaactttcagctcaacttgctgtagcaaactcagatggaaaagcaaaagtggttattcttaccgattcactatatgaaattgcgttacgtaaagcgaatgtgatgaaagaaattattgaacaatgtaaagaatgtcaggtattagagttcattgatacgccgcttgcagatacctcaagtcgtatgccgagcctaacttttagtttattacaaaaatatggtgataacttacaatacacacttgctattaacgatctctattttgattttatgacaccgtccttacgttctgcaaacaaaggagaaatgccatacaacatttctgcaggagatggttcagttactgcctatcaacgtattcggaataataatcatcaatttgctaccgtaccggaacccctgaatttacatggttggcaattagtggatgaacttaatcgtgcttttgctggagaaaaaccctctggttatgtcactcctgctcacctagtgattaaagacaacgtggcatttgatggtgggaataagaacctttatgatccacaaaatggttataaagaagcctataaggcgatttggaacgtgaagtaatcaactattgtggtcgcaaaaaattgtcaaaaaagaccgcactttcctagtaaggagagtatatgttatcagctaaaattgaagtttatgattcacgcttttaccaattagttggcactgaagctagattagaagaattgtttgacaaagcgatttgggcagagggacctgtttggctagaaaaacagcaagctgttatatttagtgatgtcaaaggcaatacaatgtatcgctggacggctgaacaaggtacacaaatattccgacaaccatcacaatttgccaatggtaatgctgtggatgctgcaggtaatttgattacttgtgaacacggtcgtcgagctattagcttaacggatcatgcaggtaatattcgagtgttggtcaataaattagaaggtaagcgactaaattcacctaatgatgtagttgtgaaatctgatggaacaatttggtttacagatccaccttacggtattttaagtgatgcagagggcaaaaaatcgcctagtgaaataattggctgttatgtatattgctatgatcctataactgacgatatccatatcgcaacttttaatgtcatgcgaccaaatggtttagctttctgtgaaaatgaaactaagctagtggtagcagatatgtcagtagtcgagtttcaaagaacaggcttacaccatcttgtagtgtttgatgttattgataatcagttatataaccgtacaagcattgctgctatttcgccaggtattcctgatggattctgtattgatcacaacaatgtgatttattgtagctgtgaaacaggactactggttttgttacttgatgggacttttttaggaagaattttactagataaaaccgcttctaattgtacctttggtttagatcaaaaaaccttgtttattacagctactaatagtttgtattgtttaacctttaaataaaaagagccggtaaggattatagaaaataatcattaccggcttttagctttatatatttattgaggattaataattttgtttagctttagcctggtcaaccactacaggatcaatataataaacctcggggatatcttgcttattaatttgtttaattgcatgttcaattgcgacagcaacttgttttttcggtaattgatcaattgtattttgcattttgccttgtttaacgtattcaatagcgagaggaataccatcatagccagttataagcactttgcctgctaatcctgcattttcaaccgcagtaactgcacctattgccatattatcatttgctgcaaaaataccttgaatgttagggttagcagttaagatgttagtggttacatttaaagcctgttctgtttcccagttcgcagattgtgaagcaacaattttgatatcaggatattcagagaatgcttttaaagctccggctttacgttgttctccattatcgacaccaggaatcccctcaagtatggcaatatttccttttttacctatcgcttctgcaaggtttttagcttctaaataacccccattaaaattatctacgccaacatagttaaaatttaatccagcttttttagctgcttctgcatcaagtcttacatctaaatcaataattggaatccctgctttttgggccttttggaaagcagggataaaggcaatagaatcatttggtgtaacaataattgcatctactttttttgcgatcatattttcaactaatccaacaagttgttcagttgagtcttctttttccgcaacttgaattgtcaaatctacatttagttgtttagcagtttctttagcaccctgttgcatagaaatgaaatattcattgcttagtgttttcatcaataatgcaatttgaggtttttctgctgcaaaaagagaggtagaaatagccaatgtacttgttataagcattgctttgaatagtttagatttcataattgatctccagtgaatttgtagttaaaaattggtagcaatcctaaaataaaacttgtctaaaaactgtgatctagttctcaaaataaataaaactttaaaagtctattttctcagcttttaagtttatttactttgtgtgatacctatcacgattttattagtatttttatgttattcttaatatacagattgataaaaagggataattgctgtgttagatactttacctattctgtcacttagaaatattagtaaaaatttctatgacgtagcggttttagacaaaattaatcttgatatatattcaggcgaagtgcattgtttaattggagaaaatggagcaggaaaatctacgttatgcaagattatcgctggcatctataattcagatggtggcgaaatgttttttcatggtaaaatttattctcctcgtaatgtaaaagacggtcaaaaatatggagttggttttattcatcaggaactaatgctagtacctcaacttactgtactggaaaatatttttttaggaaaagaacatgcgaatttaggaaatcgcatggactggaaaataatgagagagaaaacactaaaaattattcgtgaattagaactcgatatacagccggatgatttagtatcagatctttcgattgcacaacaacaaatggttgaaattgctaaagctatttttagtgaatataaagtattaatttttgatgaacctacttcttctatatctcgtaaaaatacagaaactctttttagaattattcaccggttaaaagaaaaaggtgtagcgatgatttatatttctcaccgtttagaagagtttcaatatatttcagataaagttacagtattacgagacggaaatattactggcacgatgttgtataaagaaacatctgtagaagaaattgtcagattgatggttggtcgagaaattaatttaggacattatcaaagagatacaatatttacacaggaaaaattatgtgttgaaaatattactaataaaaaaattaaatcagcttcttttactgtgcataaaggagaaatattaggatttgcaggtttggttggagcaggtagaacagaacttttaagagcaatttatggagcggatgatgctaaaggaaatatttttatagataagttaaaagtttgcattagatcaccggaacaagccgtaaaacataaaattggatttattacagaggatcgtaaactacaaggtctcatattagatcagagtattcggaagaatataacattaccaatattaaatcgtttctggacaggaattagattagatcaagaaaaagaaaaaaatgtagcagagactcaacgtgatcgcttgagaatcgtgtctaacagtggtgaacagcacactagaactctttcaggaggaaatcagcaaaaggttgtaattgctcgatggttagaaagtggtgtggatattttattttttgatgagcctacaagaggaattgatgttggtgctaaatctgagatttatgacttgatgagagaatttacagacaacggcggtactatcattatggtatcgtctgatttacctgaattaatcacaatgtcagatagggtaatggtcatgaggaatggtgaaattgtagaagaagttaaagatcgttctagaattactgaagaaaacctaatgaaagctatggttggtgtatgaggtctaaaatggataacttaaaattaattttttcaaaattaggaattggtattgcattaattgtaatgattattggaatgtcatttgcatctgatgcatttttatcagctcataatattctaaatattttattacaagtttcagttatatgtattattgctgtaggtatgacttatgttattttaactggagggatagatctttctgtaggttctatcgttgcactaagtgccgtatgcttaggattatttactcatctaggtcttaagtggttaggcgatgaagtatcagattttgccgtattagcggtggttttaattgctatattagggagcgttttagttggtgcactatgtggatatataaatggaattatcattgtgtatggtaaagttacttcatttattgcaacacttggtatgatggggattgctaggggattggcactaacgatatcagatggaaaaacaatttataactttcctgatgctctgcgtttttttggtaatggaagaatacctatttcagattcgttttctatacctatcccagtaatcattgctattttggttgtgttggttagtttttatgtgctaacgcaaacgatttttggtcgtcaaatttatgctttaggtggaaatcgagaggcggttcgtttgtctggtgtaaatgttgagaaattagaagtcaaaacatatgcaattaatggggcattggctgcagtaggtgcggtaattttagtaggacgtttgaatgcggcacaacctatcgcaggtacaggttatgaattagatgctattgctgcaactgttattggtggtacaagtttgatgggtggttttggttcagttattggaacttcaatcggtgcattaattatgggagtactgcaaaatggtctgactttattagatgtgacgtcttatttacaacgcctaattattggtgttgttattattctagcagtattttttgaccaattacggcgtggtaaagtttcaataggacaattaaagcgtattttctttagagaataacttagaagatagtctaaatagttaataattttaattattggtatgcacagttatttgaataaatatattgcttgctgaaatttaggataaggaatagtgaaatgaattacacacttggtattgactgtggaggcacttttatcaaggctgcactctttgatacttttggaaaaatgattggttgcgtgcgtgaaaatgttgatgtgattagcgagcaagccggctatgccgaacgtgatatgtatgaattatggcaagtttgtgcaagtgtgattcgtaagacaattgaacatagccaaattgaacctagtaatatcaaaggtgtgggcatttctgcacaaggtaaaggtgcttttttattagataagaatcatcgacctcttgggcgtgcgattttatcttccgatcaacgttcacttgatatcgtgaaacaatggcaagctgatggtattcctgaacaactttatccaataactcgccagactttatggacaggtcatcccgtctcaattttgcgttgggtaaaagaacaccagccaaaacgttatgaggaaataggtgcggtattaatgtctcacgattatttgcgtttttgcttaacaggaaagcttttttgtgaagaaacaaatatttctgaatctaacttatataatatacttacaaggcaatatgatcctgccttggctgatttactaggtttatcaggcattattgataaacttccgcctattattgagtccaatcaaattgcaggctatatcacgcctgaagcggctactttaactggtttatgtgttggtacagttgtggttggcggattatttgatgttgtttcaaccgcactttgtgcagatttggatgatgaaactaaacttaatgctgtattaggcacttggtcagtgataagtgggatcactgatggtattgacgataatcaaacacttccttttgtttatggacgctatgcacaatctgagaaattaattattcatgaagccagtccaacttcagcaggtaatttagaatggtttgtgaagcaatggcagcttgattatcaacaaattaatcaacttatcggggagcttgaacctgctaccagttcagttttatttgttccatttttgtatggttcaaatgcaggattaggtatgcaagctggcttttatggtctccaagcacatcatacacaagctcatttattgcaagcaatttatgaaggagtactatttagtttaatgcatcatcttaatcggatgttacaacgctttccaaatgtgaagttattacgtgttacaggtggtccgacaaaatctaaaatctggttacagatgcttgctgatctcacaggaatgaaactggaagtaccacaaattgaagaaacgggatgttttggagctgcattgatggcgaagcagggttctagtgagtcaaccactgatgttttccaaacgcaaactatgttcagtgttgagcctaatcctatttatttcacagcatatcaaagaaaatatcaacgttatcaaaaacttatagattcgttaaaagcaatgatttaatgaggaaaaaatgacaaagccacttattcaacttgcactagatgaaacagatttaaacaccgcacttgttactgctaagcaagtagcagactcggttgatgttattgaagtaggcactattcttgcttttgcagaaggtatgggagcagtacgtatgttacgagcacgatatccaaagcatattttagtttgcgatatgaaaacaacagatgcgggtggtattttagctgaaatggcatttaacgcaggtgctgactggattactgtttctgctgcagctcatattgcaacaattgagagttgtaagaaaatagctgattactatcaaaaagaaattcaaatcgaaatctatggcaattggacattcgatgatgctcaagcttgggtcgatttaggtatcaatcaggctatttatcaccgtgcacgtgatgcggaaatagcaggtaaaggctggacggaagatgacttagtaacaatgaaaaaattatcaaaaatgggattatcgctctcaattacaggtggaattgtgcctgaaaatatctatttatttaaagatatcaatgctaaagcatttattgccggacgggcttttacaggtgaaaaaggaaaatttactgtagaaaaaatgcggttagaaattgataaatattggtcctaatattgcagagataaacatggagtatattgtgagaacacataaaatcggtatttatgagaaagcattacctaagaacctaagttggcaagaccgtttatccattgcaaaagcatgtggctttgattttgtcgaaatctcaatagatgaaacagatgaacgtttagcacgattagattggagtaaagctgagcgtattgaattagtaactgctattatttcaacgggcattactatcccatctatgtgcttatcaggtcatcgtcgctttccatttggtagccgggatgaagcaactcgccaaaaagcctttgagatcatgaaaaaagcaattcagcttgctgttgatcttggtattcgaactattcaattagctggttatgatgtgtactatgaagaacaagatgaaggaacaattcaacgcttccagcagggattggaatgggctgttaaacttgcggcaagtcaccaagttaccattgctgttgaaattatggatacacaatttattagctcaatcagtcgttggaaaaagtgggataatataatccgctcaccgtggttcacagtttatcccgatttaggtaatctttctgcttggaatgaaaatgtgagtgaagaactcaaattaggcattgataaaatatcagcaatccacttaaaagatacttataaagtgacaactactagcaaagggcaattccgtgatgtacctttcggtgcgggttgtgtagattttgtacaatgttttcgtaccttatctgaattaaattatcgtggtgcatttttagttgaaatgtggacagaaaaagcagaagaaccaatcacagaaattattaatgcacgtcgttggattgaacaaaaaatgaaagagggtggttttcaatgttagaacaattaaagcaaaaagtatttgaagcaaatttagcgttacctaaatatcatttagtgacatttacttggggtaatgtaagcggtattgatcgtgaaaaaaatctagttgtgattaaaccttccggagtggaatatgaggtaatgacgcctgaagatatggtagttgtggatttattcacaggtcgagtagtggagggcaataaaaagccttcatctgatactgctacccatctaatactttaccgtgaatttccaacacttggtggtatcgttcatactcattctcgtcatgctactatatgggcacaagctggggaagatttgattgctgcaggcacaacccacgcagattatttttatggtgctattccttgtacacgcaaaatgacacctgtagaaattcagggtgactatgaacttgaaacagggaaggtaattgtagaaacatttcgtgtacgagggattgatcctaaagatgtgcctgcggtattagttcattcacatggtccttttgcatggggaaatgatccggataatgccgtacacaatgctgttgttttagaagagattggctatatgaatttatttagtcgccaacttcgtcctaatttatcttcgatgcaacaagaattgctggataagcattacttacgtaaacatggtaagaatgcttattacggacagtaaatatgacataagtgctaaagtaaattgctttagcactgagttttagatgttattaagaatagcgtctaagacagaagcaattcccgctttatcatggtgtagagtgatcaggtttgcttgttgtttaatttcgtcctctgcattacccattgcgacacccagtccaactaatttaagcatagaaatatcattatggttatccccaaaagccacaacaaattgagggtcaatgtgccatgtgtttagtaactccaataatcttgagccttttgtatttccgctattggcaatatcaacacgatcaacccatgaccactcacaactaaacccaattgaagataaatgattaaccgcagtttgcatcaacgcacgatcaggatggctaattacaaatttccatatcgtttcctgatcatttaataacacattaaaatcaggaacatggcgtagtttgggatgtacttggggaggacaacgctgtacccattcggaaaatttacgcagatgctcattcattattgagtaattcattgtatcacgtgaatacattaataaatgtaaattgtatttttctgccagttgaatgacttgtcgggattgttctaaagagagaggatttgctgcaagtacggtatctgtttgtggttgatacatataggtaccgttacaacaaatcatgggagtagttaaattcagctcatggtaataaggataggcggcagtatgatgccttcccgtgactaaaatgacttttaagcctttatcaatacaacgttgaatcatgattttatttgacgttaaaatttgcccttggctatttaacaacgtgccatcaagatcaaacgcaatgacttggtatttcatcttttttcctattttgaatatcatctaattggtaaagtatagagctttttaagtccaaagggaatatattagtctttgcagggataggacaactgtataattctgtataggaaaattaaataaaactgaccgcacttttatgctcaccttataccgttacgatgcaattattttcaataagtacaatgatgaaatgtgttatgattaacacatttccagttttgatgtagagtaaattatgagtcaacatgaatctcacttcaatcattttgccttagccgaactgtatccttttgctacacaatttcctttgcaaaatataataggaaaaaaaggcatgcgaatcgtctatcgccattttgttcaagaacattgtgctgaacgtagattagtgattttggtcaatggacgtgcagaaaacttgttgaaatggacagagttggcttataacttttatcgacaaggctatgatgttttagtgtttgatcatcgtggacaaggctattctcagcgtttattaaaagagcatgacaaaggctatattgatgagtttcgtttttatgcggatgatcttactttgttagtggaaaaaattacttcgttgtatcactatcgtagccaacatattttggcacattctttaggcgctttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggcatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataaacacgcctaatgttgtaaaaaacaagcaaccgagaatatgtaacgatgtaatagttatgccttctagccatttatgttgaagcagattttcaataatttctgcactgaatgccgaaaatgttgttaaactacctaaaaatccagttacaaaaaataggcgatattcagttgaaaaagcagacgaatgccaaaacatagccagcattattcccataattaaacaaccgatataatttgcgattaatgtgccaaaggacaagaaagtaaacaacggattgagtaataatgtcaatccatgacgagacattgcaccaagagaagcaccacagctaattaagaataaatgtgtaaatagattcatatgtgtataataaacagaattaaatgatgttaaatagcgtgcagagatacctcgctaccgattcttgtgcgtttaacccaatgatttctaaattcgggcaagctgactttaaacgtggatcagcattgctcatcacacaacctttatcaacttgggttaacatttgtatatcattcataccatctccaaaagcaatacattgctgcattccataattccgctcggctaatacctgctctagtgcagtggcttttgatacattttgattcattatttctaaacaaacgggagttgaataagtaatgctgagtttatctccatatgtggttttgagagatgtttcgatattgactaagtcttgcggttcccggccaaggaaaaacactttttctgtagtttttccatgatgttgagcaaaattcactactttatacataaaaccggaatcttgatggtatttacgcaactgaggaacttctgtattaataaaccaatcatccccttgatatgaattaacacatacatgtgtacgatcaaaaggcaagttcataatttcaaatgctattgtttcaggaatgtaattgtggactaaaagattgccttgcaaatcctgtgctcttgcaccgttagaagtaatcattactgcatttttgatcttaattttttttaagattggtagcaaatccgtatggttacgccctgttgctaagataatatctataccttgagatgcaagcttttgtagtgtctcgatagtgaaatcgccaatcatatgattggcattaagcaatgtaccgtctaaatcagagacgatggcacgaaaaggaacattttgcatagcctatctttatcctatactgaaatcacagaacagattatttaacccaagtgacgatttcatcaagggatttacgggattttggcttaatttcttttgctcggtagccgaaagttgccattaccgaaactccccattcgtctgaatctaatacacctgcatcagttaaaatttgatttactttttcataattaaaaccttcaattggacaactgtctattccaattaatgcagcaccagttaacatatttgctaaggcaatataggtttgtttacttgcccagtcaaataaagtgcggtcattctcaagcgttttcatatgttctgcttgaaagagatgatatttttctttggtagcttgtatttgttcgccggataacccacgtcttttcatggattgtactaaaaattctgaatcatagcgtgcattctttttcgctaagataacaactaaatgactggcatcgtcaatttgagttgccattccccagctgacaggttttaattttgcccgtagttctggattttggattactaaaaaatgccaaggttcagagccgacagaacttggcgaaaggcgagcaaattccaaaacataagagaaatcttcattgctgatttttttatttggatcatagtaacgtgtggatgcacgacgattaaaactatccagcacgtgttcttttgaaatagtcgtcataataaatgtcctttaaatatttagcgaattgccatttggaataaaaccacttcagcttgacaaccaaaaacaatacgcatttttaaacgaaaaccatttgaaatgtcggtaatttgactctcaatatttgcagggtcattttcaatatcacgagctttctgaataaaataatcacgagcgttcaacgcttgtttttccgtatcgtattccgcttcaaaaacaacttctcttgcggaattatccagcattgaatcgcctttgatacggcacatattgtgtgcttctgccactttttgttgcaatgttttatcactcatgattatttccttatgcttaataaattaacctaccacactcggtaataaacctgcttgaactaggaatggaataatcacgataaatacaccaataactaatacagcgataagggaggctgagccaccttttactcgatacggtaagtgcgggtaaattttacgtaatttccataccattgcaataggtaaaacgattgcatagaatgcaaacatttgtcctgcatatcctaaagctagaataaatccttggggatagaatagtgcaaaagcaagtggcggtaagaaagtgagcagaccaactgaaacacgattagctgaaatatttactcgttttagcagatcttcaatcgcttcgaacaaacctaaggcaacacctaagaatgaagtaattaatgcaaatgcagagaatagacgaactgcaccgccaataatttcacttcctgtaattgtaattgttgctgtcaccaatccatttaaggttggatcttgttgtaagattgccaaaaattctgtttggcttagtacgccatgagtggctaattgccatagaatataagcaacaagtggaataaaggttccgactaagatagaaacgcgtaatgcctttacatcgccatcaaggtatttattcaggctgggaatagaaccgtgaaagccgaaagaggtaaagaaaatagggcttgctgagatgattaaggcattatcaattggaagtgcgagtaagttttctaaagaggctttaggcagtaataagaaaagcactacaacaaagaaagcaattttactgaaaaaaatgatgcgattaatcttatctacgctatttgtgcctgaaataatgaaaataccgaaaagtacagtaaataatacacctgcaatccgagatgtggtttgttcatcgtgaatggtgggcaacagtcctgcgagtaaagagcttccgccggaaatgtaagctgaaactaaagcgtaaagaaaaattaacagtacaacagtagaaagaatacgtccgaaagatccgtaatatttttcagccaaagtcccaattccagcatcactgtctacagtctggtatagctcaacgaaaagtagggcggcaaaagagagtaatagccaaagcccgattaataaagtaagtgtaaagccaaaaccgattccggctgaggttaatggcatagcgagcatgccaccgccaattgttgttcccgctacaataagcgtacttccaagcgttttgttcatatttttctcccatgatgaaaataaaagtgcggttattgtaacttatatttttttaaaagtgtaattttatttttacaaaatgtaatattatatttacacatttgttttgggaaagagaattggcttaggatcttgatagaacaattgtactttttgtccaatttctaaggattgcattgtttgaatggtgatttgttgtacatcagatagagtaacttggtactgataatattgccctaaaaattgactttgagttattgtgccatgtccctgtaaagttggtatgacctgaatttgatgtgggcgaaccagccaatgtaactccgtattttgtaatagtggagattgatcagcaagtgtgagtaagttgtcgataggctgtataccaaagattgaatgtaattgattttgttgatcaatatagcaatcaatatagttatatttccctaaaaattcagccacaaatttactgttaggttggtaatagagttgatctgttgctccgacttgaataatttttccatctttcatcaatgcaatattatcggcaaaagcaaatgcttcttctttgctgtgagtcacaaagattgctgaaatgctttgttgtttcactatttgtttaatctcatcaatcatttgatagcgaacttggctatcaatatttgaaaaaggctcatcaagcaatagtagttttggcttgcatgctaaggctcgagcaatagcgacacgctgttgttgacctcctgacagttggtgagggtaacgatcttccagtccatctagatgaactaagttaagcatattttgcgaaatttgctttttttccatcgcactttttttatccaaaccaaactgaatattttctttgactgttaaatgaggaaaaagagcataatcctgaaaaataaaacctatgttgcgttgttctacagggacaggtgttaaatcttgtccatttaagtagatttttccttgtgtaataggctgtaatccggcgatggcttttaatagtgtcgtttttccgcaaccacttgctcctaataaacataaaatttcattttttttcaattctagatcgagttgatgtaagacaatttgttgtttgtattgacaactaagtgattgaattttaagactattcattatcgatccttttctgaatgtaaaatgagtgaacgagtgagccaaataacagggattaaaccaacgagaattaacgttaatgcaggcaaagcggcatgttctaattgttcatcggaagtaaaagaaaaaacataagttgctagggtatcaaaattaaaaggtcgcaataacaatgaggcgttaagttctttcatactttcaataaacaccattaaaagtgcggttaaaattcctttagaaagtaatgggaagtgtactttttttaacatttttatgccattagtacctaagctttgacttgccatatctaatgtaggaggaattttttgtaatgatgtttcaatacttccgagagccatagcggaaaagcgaatgacataagcggaaactaaagcaaacattgatcctgaaaaaattaatcctacaggagataaatttaactgagccagtatagcgttaatttgatgatccgcaaatgtgtaaggaattaaaataccgatagctaaaactgtacctggaatagcgtagcttaaactcgcaaagcgtaaggtgaattgtgcactacgttgtatgtgatttgaatgtagatttaagcgttggtaaaaatgtaaaagtagggcgaaaattacacaaacaattgaggcggtaatagaaactgacaaactgttataagcatattgtgaaaatttattgagctgtgattgttcaaaataatgaattgcccaataactcaattgtgcaacaggaataaagaaagcacaagtgactaatccccagcaataagtttgtactaaaaagccttttattccttttaatggcttaagtgcggtctttttttcataccctcgttgataggttttttgtttgtaacggctataattttccagcaacaagagactaaaaataagcaataaaatgaacattgagatttgagcagccgagccgagatctcccagtcctaaccaagtgtcataaactgcggttgttaatgttggcactgcaaaataagatacagtgccgaaatcgcccaaggtttccatcgcaactaaagcacaaccaatagcaattgcagggcgagttaaaggaaaaataattttttgtaataacttgcgtggtgagcttccaagtaatttagcactttgaattaaattttcgctttgttccaataaggctaaacgtactaataggaaaatgtaagggaaaagaactaaagcaagaacaatgcaagctccccataatgttctaatggaaataaaccaataatcttgtgcacttgaccatgaaaaagtttgccgtaaaaatacttgtacagcaccggcatagtctaataaatccgtataaagataagcaactaaatagccgggcatagcgagaggtaaacacaatagccattgtaagattttttgtccggtaaattgatattgagaaataaaccaagcacaaggcaaagcgaaaactaaactaaaagaaacagttccaataacgagaagcaaagagttgagcagataatcaaacagaacagtttgccaaagatgttgaatgttttgccaattgaggctccaagattgataaaaaatagcaatgatcggtgttacaaaaaacaacgtaataaaaagtgcggttaaaaaccaaataattttatttaatcttgaggaaaataaaaacattcgaaaactaattataaagtaatgtaaagtttaatggggcaattatagcataaactcaaagtcagtgagatcattaaatgcccagtttagaaacaggataaacaaagaaaaaagcctagtggatttagcatactaggcttgttcttttagcaaatattaaagatcgaatttgacttcatcaataagttttaatgctttatcgtagttttccgctattttatttagtggcagaggatctttcttaaatgttccccaagatttcactttttcagacggttcaacaccagcttttactggatattcatgattaagctctgcgtataaatgctgtgctttatcaccacttaaatattcagcaagtttaattgcattttctttatttggtgcatattttgcaatagcgataccgctaatattaacgtgagtaccttttgctttttggttagggaagttgatataaacagcctccgcccaagagcgttgtttttcatcgtctagcattttgccaaagtagtaactattgcctaaagaatagtcacatacaccttctttaattgctttaacctggtcacgatcgccaccttgtggtttttgtgccaagttgttttttagtccttctaaaaatgcttttgcttttgcctcaccatcatgagcaatcatagaagcaacaagagaaacgttgtaagtgtgtttaccagaacgcacacaaacttttccttttaattcaggttttgctaagtcataataagtgaaatcagcaggtaatttacctacacgatctttagaagtgtaaatcgcacgagcacgagttgttagtccaaaccattgatcattagcatctctatattgtgctggaatatttttttctaagatttcgctatgaataggttgtgcaagacccgcattcacaatttccatcacacgtttaatatcaacagttaataatacgtctgctggacttaattcaccttcacgttttacacgttcaactaagcctttattatcaaaaagaacattaactttaatccctgtttctttttcaaactcttttaaaattggttcaataagataaggttgacgataggaataaacattaacttcatttgcagctaaagcactggcggaaacggtcgctgctaaggctaaggttaatgtgctgagtgattttttcatgaaaactccttgtaagaataaatattaagtaaaggatacgaaagagctgtattagatactttaatagattaaaagtcaataagaattattcttgattgtgtaagtaaaattttaagttttatgaccgcactttacacaaaagggaaaataacttgattattttcccttttaattcaatttggtaaagcggttattgccaatattttttctttgaggtttgacctattcccggattgaaactatttgttgggtcaagggctttgtagaatttgcgtaattccggttttgcttgatacaaatgcccaacattatgttccgctggatattccgcaccacgctgatctaataaatcaagcatttggtgttccaattctgtacaattatgaccttttttaatgatatagtcttggtgaaaaacatggcacataaaatgaccgtaataaagtttgtgtataattttattttcaatttcagcaggtaatttttcaaaccattctttgtcattacgacgcaaggcaacatccaaagcaacgatatcttcaacatctttatcgtgaattgcacgataacgaattgcagccgaagcaacagcaaaacggtgtaacattgctgcttgagtttcttctgtattacattggaaataattacctttagatttatcggaaaaatactcttttaagtattcttgagcttcttgaacacctgtaccacctatttttacaataagatgatgttcatattggtcacggtattgccataaagatttcggtaaatgttccggcatcgcttttgataaaagttgcataaacttatcactgaaatcattgggtaaaaaactgacttttttggcgattcggtcaactttagctttcaaggcaaataatttaggtaagcggtgtgtgccaaattttttaataatccaaaaagtatctttaccgtatttggcggcaatgtcaaaagcatcacgatgaatatattcgccagagattggcaattgttggaaattagctaacatatgacgacgaatgtcgtttaatacatctgtttgatttgttccaatgtagaaaactgcggtatgtttttccatcggaaacgtatctaagcggactgcaaaaacagctaattttccggcactcccggaagtttcataatgtcggcttggatcagcgttaaatcttgctggagagttttcatcaatttggcgtacatgttcgcaataagaatgatcgtgtcctctgccacaatgttgttgaatatctttgcgttgataacgttggttttgtaaattttccaaaatttcttcaggatcattacctaagtcaatgcctaaatgatttttgagttccaattctccctgttcattaagttgagcataaagtgccatttctgtgtaagccggtcctctttgcaccaatgcaccgcctgaattattacatataccgccaataacagaagcaccaatacaggatgaaccgataacggaatgaggctcacgcccatgtgtttttaataaaatttccaattcatttaatgtcgaaccaggtaagcaaacggcttgctcggcattattgattagctgaataccgttcatatacattgtattgataatcacaatatcacgatcatagtcattaccgcttggtgttgatcctccggttaaaccggtatttgcggcttgatttataataattacatcggcctcaacacaggtttttaatacgttccaatattcaaccagattagtaggacgaacaacagcaatcgcatttccgttgccaaaacgatagccgctacgataactttcagttttacttggatctgtaataataaatttattgcctacaatgtcggtgagcttggaaataagttgttgagttgtcatcgtcataaaatgctcctttcttatttgaaaaaatcgacaacattataacaaatgaaagttgactagaaatgatgaaattctattcaattatacagtttttttgatgattaaaaagataattgagtttgagctaacaataaaagatgagttttgttgagaaatatgatacaaaagacaccgaatttttatttactcttaattaggaaacgatatgtcgaatttacaaaatattattgagcgtgcatttgaacgtgtagcagaaattaccccgacaaatgctgaagcagaacttagagcagcggtagatgaagcgattgaaggattagataaaggtatttatcgtgttgcggagaaaaatgaacaaggcgaatggattgttaatcaatggttgaaaaaagcggttcttctttcttttcgtttaaatgacaatgttgtagttgatggtgcagaaacaaaatattatgacaaagtgccggtgaaatttgcagattatgatgtagaacgttttaaaactgaaggatttagagccgtaccgggagcggttgttcgtaaaggttctcatatttctaaaggtgttgttttaatgccgtcttttgtcaatattggtgcttatgtcggtgaagggacaatggtcgatacttgggcaacagtgggttcttgtgcacaaatcggtaaaaatgtgcatttatccggaggcgtagggattggcggagtattggagccattacaagcaaatccaacgattatcggcgataattgctttattggtgcacgttctgaaattgtggaaggtgtgattattgaagaggggtgcgtaatttccatgggggtattcatcggtcaatcaaccaaaatttacgatcgtgaaaccggcgagattttctatggtcgtgttccggcgggttcagtcgttgtatcaggtagcttaccttccaagtgcggtaaatataatctttattgtgcagtaattgtaaaaaaagttgatgcgaaaacattaggcaaagtaggcattaacgaattattaagaactatcgaatagctaaaattcatgtagtttctattatctacctgcctcttaacataagaggcagattttttataaaacaatagttttattttgatacacaaaaattctgtcatgaagtgccaaatctaaagcctgcgttagtaccgctttttctacatcacgtcctgctttcatcattgcttccgcattataagtatgatcaacattaatgacattttgcataataattggtccctgatctagctcattattaataaaatgtgctgtcgcaccaataattttaacccccctttcataagcttgatgataaggttttgcaccgataaatgcgggtaaaaatgaatggtgaatattaatcactctattgggataacggctgacgaattcgggatttaaaacacgcatatatttagccaaaacaatataatctggagcatattcgtcaattttttcagctagtaatttatcatgttctactcgagttaatccttcatggcttacacaatgaaacggaatatcaaaacgctcgactaacgaacataaagtttcatgattcccaatcacagcagcaatttctacatctaatccgccataataggttttcattaaaatatcgcctacgcaatgtgcctctttggtaactaaaattacaatacgttttctttttgcatcaactaaacggcaatttgtaccattcggtaaactatagtctaaatcggcaagtaaagtttgttgattaaaaataccttccaattcagtacgcataaaaaagtgtttagtttcaaaatcaacaaattcattattatgaataatattgagctggtgtttgtaacaaatattagtaattttagcgattaaacctttatcatcaggacaatctgttaataggattttattttcaaccataataaatagtgatttattgtgttaagttaataaaaacttaagttagagatttatagcatgattaaatttcgaaatcagccaatgtttttcctgtatttaattcagcttgcagagataaaggcatacgcccctgacccgtccaagtttttactttaccattttgatctgtatattggtattttgctttgcgaggagctatttttttacgagggcgtttagtggtaaaggttggatcatcgactaaatcagtcaaggttaagccgtcttgtgctagcaatgctttatattttgcgatacgttccaaacgttcttgttcttttcgttgattttcttcaattagttgacgtcgttcatttgtaattaattgaaatttctccaatatactttctaactcttgcagagtgaattcttttgttgctacacgcaatgctcgaatactggttaatgtttttaataggtcagacatttttactccttaattttatattgataattcgctttcaaataataacgaaaaaatatttttaggtaaatcttaatttaaaaatagtctaaattttaattttatatattaatttaattattttacattaattatagattaatacttggaattttgattttcttattgtaatcttactcgctcctacatatgtagaggtgcggctgttataagtaattttttgagtggataacgatgaaaaaaatgaaaggaatagttgccgaaatcaattaaaagtcgttttaattggttgggggcgtattcgaaagaaacgtcactgtcatagtatttatccactatggagcgctactggttaggttggtatgggttattttgatcaccttattttaattatatttaaaatatcaatctcagtggttctcccttaaattaggaagaacaacatggaacttgtaaattattccacatctatttattcggttattccaccgatattagctttgctattagccattgtaactcggaaagtcattttatctttaagcattggtattattaccggtgctttaatgttgaccaaagatacatccatattggatagtattccttatttgtggaatcatatctccgctttggtttatagtattgaagaaaacggctcaatcgcatttgcgtgggacacaataaatattatcctctttttagttttacttggtattttgaccgcacttttaactgtatccggtagtaaccaagcctttgctgaatgggctcagaaacgtattaaaggtcgtcgtggtgcaaaattaatggcggctgctttggtgttcgttacgtttattgatgattatttccatagtttagcggttggtgcaattgcccgtcctgttacggataaattcaatgtatctcgagcaaaattagcttatattcttgattcaacagcagcacctatgtgcgttatgatgcctgtatccagttggggggcttatatcattaccttgatttcgggactattagcaacttatgccattaccgattactctccaatcggtgcatttatggcgatgagttcaatgaatttttatgcaattttttctattttattggtatttttcgtggcttatttttcatttgatattgggtcaatggcgagacatgaaagattggcattagagagaggggatacagaaagagaagttgaaatacaaacaaagataaaagggcatgtacgaaatcttgttttgccaatagtggtattgattgtagcaactgtggcaatgatgatgtataccggcggacaagcattaattgctgacggtaaagcatttagcgtgctgggtgcatttgaaaacacaacggtagggatttctcttgttgttggagggatagcctcagtagtgatggttactctctgtattttaactgatggtcagattagtttaaatgaatatattaaatcttggggattgggtgcaaaatcgatgtccggtgccattttaattctgtgctttgcatggacgattaattcggttgtgaaagatatgcaaacagggacatatttatccagccttgtatctggcaatcttcctattgcaacgttaccggcattacttttcatcctcggtgcagtgatggcattttccacaggaaccagctggggaacatttggaataatgctaccaattgccgcagaaattgcatcaaatgctgcccctgaattaatgttaccttgcttatctgcggtaatggctggtgcagtttgtggagatcattgttcccctgtatctgatacaacaattttgtcctctactggagcgaaatgtaaccacatggatcacgttacaacacaattaccttatgcgttaacattagcagtcgcaaccattgtaggttacttagttgttggcttcacattatctggcttattgggttttattgcttgtgctgttactttagctgctttagttttaattttaagaaaacgctaatatcgttttaattttgtttttgaaccgcactcataagtgcggtttttattagagcggagtttaaaataagtgtagaatggacaaaagttatcgttcatttcttatttaggagtaggagcaaaacatggcaattttagttactggcggtgccggctatatcggttcgcatacggttgttgaattgttaaatcatcatgttgaaattgttgttttagataatttatcaaattcctcggaagtttctttacagcgagtacaacaaattaccggaaaaaatatcactttttatcaaggcgacattttagatcgagaaatactacagcgtattttttcaacacataaaattgaagcggtgatccattttgctggattaaaagccgtgggagaaagcgtaaaaaaaccgttgcgttattatcaaaataatgtaattggttcgcttacgttactggaagaaatgctaaaagcaggcatatataacttagtttttagttcatcagcaactgtctatggagaccctgaaatcattccaattaccgaaacttgtaaagttggcggaacgactaatccctatggaacatctaaatttatggtagaacgtattttacaagacgcagtgagtgcaaatccgcacttgagtgttgtcatacttcgctattttaatcctgtcggtgcgcatgaaagtggtttaattggtgaagatcctaatggtattccaaataatttattgccttatattagtcaagtagcagtaggaaaattaccacagctttcagttttcggtagtgattatgatacacacgatggtacgggagtacgtgattatattcacgtagtggatcttgcaaatggacatctaaaagcactggagaaacaccaaaatgatcaaggctgtcatatttataatctaggcacgggaattggatattccgttttggatatggtaaaagccttcgaaaaagcaaatgatattcaaattccttataagctagttgaacgtcgttcgggtgatatagcaacgtgttattccaatcctcaaaaagcattagaaaaattaggttggaaaactgagcgagatttaacacaaatgatgaaagacacgtggaattggcaaaaaaataatcctaatggttataaatcgtaagtcgtaagtgagcgttttaacatacggataagacaattcagctctcaacatttcaataacaacagaacaacattgattgtttctgttgttattttaaacgatttagcaaaaaagataggcgataaatcgcaaagaataaacttttttctaaaaaacattttctttacatttaaagttaggataaaatcgcccgaataaattaataatacttgacaaataaaaatagaatagaaaaatgtctacagtctacagtctacagtctacagtctacagtctacagtctacagtctacagtctacagtctacagtctagtatattgcctaaaatcaacctttcaagttaaatttgggaggttggacatgttcaaacaatatcttaaaaatcacctatttcaacctcaacctttcggcgaaagtattattcgcctttttttgttgtgtcttaaaaagcaaggcatcgccgatttatttatcaatctatctaaaaagcaaagcgtttaattaatcaaaaaccgtaaaaaagttaaaaaaaatcaacaaaataaacaattgaaaaaaacattttaaaagcttaaagagagtgaatttatgaacaaaatcttcaaaaccaaatacgatgtaacaactggacaaaccaaagtggtgtctgaattagcgaataaccgccaagtggcgagccgtgttgaggcgacggggcgtcagccgaagtgcggtgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaagaaaactcaatcgctttaggaacgggcacaacagtaacaggtgcgggcgttgtggctatcggttccggcgttggtgtaacaaaagacaatacaatagctatgggttatggagcattgggaaaatcaggagaaagtattgttttaggtaattcagcaaaattagacgaccatgcctcaaaatctatcgtgataggtaatggtgcaaaagttgaaaatataaataaaactaaaaaaattgacgaaatgcattggcctgaggatgaaaaatataggaagggtgaaaaagaattagaaatgtcggctattgcgataggaactagtgcaatagctaacgctcaaaatagtgtagcactcggaaatgaagctcaagtaagcatggaaaattcggtggcattagggaataaatcacatacaaaatatttctatcaagatgataataacaaaaacactgccacgctcagcggaaacggcaaaaatgatgcgattratttagmcccttatrttccagakggktcwagytataayttmaraaccgatagarcsgcgggtatcgtgtcagtcggttggacaaaagatggcaacggcaaaacacaagagytgggyytragaaggattgtcggggtagcaccgggtgcgttggactctgacgtggcgaccgtagggcaattaaaagccttgtattatgtgaaaaaagaaggtgtggtaacttactataccaaagacggaaataatattatcaaactcaccaaagatgctgatggtaagttttataaagtcaacaccaaagacggcacgccttacaaggacttagaggaaatttccgcagataaagttttcgtcggtccaaaaggggcgaatgaaaccaccagagaggaaacgattcagcggaaaaaatactctcttggcgacatgggtaataaaatcaaatttgctaatattttagatggcaatattgaacaaagctcggatcaagctatcactggtaatcagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaagatgctctcactaaggttattggtgcaattaataaaggctataaatttagtgctgatgagataaaagataaagccaatgaaacgcctttctatcttggtgctaccgttgaaattaaaactggggatgttacaaagccaggtaacacgacagagaaatatctaggcaaaaacntaaaaacagaatttaaaaacgatagttcaaaagcgacattcaccatcggcttgaaagaagmcccgagctttaaaaaagtcacgattgaagacaagattgaggataaagaagctaatgaaaaacttgccgtcaacaaagagtatgtggataacaaacttaaaaatgtctcgaccaatttrcattwyttatcagtaaaagggamkgataagaacgcaggcaactacaataacgatggagcaaaagcaaattattctgttgctattggggtgaatgctcaagtagtagatcctactactagtggagtgcctcctaaaaaaacaaaaccgacagcaacagcaggtatagcgataggatataacgctaaatctgaagcagaaaatgcggttgctataggtagagatgtaagtattgacgtaccgaattcttttgttatggggtctaataatayagttacrcaaagctttaaagagacaaatggtgcggttgttgtgatcggtagcggaacaaaattagtagaatcaaaaagttctatcgctatcggtgcggtgtatgtggaaagaggtgacaaaaaagatggtactgtaatagagaatgcagcatggacagcgtctatcggtaataaaaacaaaatcaaaaacggtacggatattgtggcgttagggaacaatattgaagttaaagatgagacgaatgaggaaaatccaaaaaataaaacaaagaatgcgaatacagaattaattctgattggtaatggwgcgacagckgaaacygcaaaagaaagtgtgcttattggggcaaaatcaaacgccggcaagggtgcaaaaagtgcggtrattatyggtcatagtgctaaagcngagasaaacgccgtcggtgcagtagcgattggrcaaggtgcaacagtaaaaaccgmcgccggcaactccattgcsttggggcaagggtcagaagcgacarmwaaagaagaagctaaaaaagacactactgtarctattgacggtaaaaatattaaatttaaatggacagctggtgttagttctagtagtggagataaaaaatccgttttaagcataggtaaggcaggtaatgagcgtatcattaaacacgtcgccgcaggtgcggtagataaaaattcaaccgacgctatcaacggaagccaactttacgctgtcgccgatgaattttcaaaattagcggtgaatgtattgggtgcggaaaaagccgacggygatacagyaggatttaaaaaatcgamwtttgamgtrgctaaatatcagggaagtacaamtrcwycarcacmaamagaaatgacctttaaagasgcaatygstcaaaatacaacagcgattaataaaggctttatttttggcgttggcgawsramstgrtgaawawggaacgcattayytaggcgataaattaaymatcaargcgggagcaatcgataaaccgacgacaatcacgacatcagaagatggctattcgccgaataatattaaaacgcactatgaaaaaaatagtaaaaatatattaatcggcataaaagataaaccgacgtttaaaaatgtgattattgaaaatggtattcctgaagatgaggaagagcttaagaaaggtaattatgataagcatgctgtcaacaaaaaatatttagacaaaagattagaaaaagtcgccgctaatttcacggttaagggggataatcctaargmtggaraaggwtatacmttagataaagakcataatgaattaaatattaacggagatagtgaaaatatcacaactgaagttgataaggaccataaaaaagtgagcataaaattaaaagatgctttaacaggtatcacttcaattgctaataatgatacaaaaattgagctaaaaaatggaactggtggaaatggaacaaaatctatcgttttcacagctggcgataacaataaatctgtaacactaaccggagataaattcagtggtgtgtctgaaattggaaaaaatgatcaggctaaaatcactttcaaaaataatggttcaaatgaaatagactttaaagcagggagtacaacctataaattcactgacagcggattagatttagccaataaaccaataacaaatctagcaagtggattagataatgttgtaaataatggtaaaaaagacttagacgaattattaaaacttatcgggacaaatgggcaaccaagcggatcttcaaatgatggcaaattaaacaaagcagtcaatgttaaagatttacttcatgtcgctaatgaattaaaaaataaagggctgactttccaaggaaatggtgatgatactgacaaagttaccagaaaactgggcgaaaccttaaaaatagttggagaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattcagtggcgtgtctgaaattagcagtaaagataataaatctacattaaaacttggtgctgataacgcaacggtagaattagctcatgacaaatcaaaacttgaattaaaagatactgaagcaacaatcacagctggagataatgccggaagtattaaaattacaagtaatggaagcaagacaattgaattaagtcctgaaaatggagctaaattaacacttgcaaaagatagcactactaatagtggctctagcaatgttaaagctactggcttatctcatgttgggttaaatgaccaaaacgctttaatctttaaaaatggaagtagtaatagcaataccgctgttttaaaagtaggtaatactgatttaacatttacaccaaccggaagtaatggaaatcaaaaagtccagatttcaggattatcaagcggattaactgatattggttcttctaccggtactagtggcaataatagtactcaaaaattagatgaattattaaaactaaaaccacaatcaagtggaacatcaaataatcaagacaaattaaacaaagcagtaaatgtagaagatttacttgatattgctcaaggcttggttgataaaggacttaaattccaaggaaatgacacttcaagcacaataacaacaaaactgggcggtactttaaaaatagttggagaaacagcaacttcaacatcgggaacaactgcaacaactcaaattaccaccgcacctgataacattactgttaagaaaaaatcaggtaatgacgatactttagaaatagggttatctgatgctttaaaaggtattacttctattagtggtaaaaatggcagcaatggaagtgcggtagcgaaaattgaatttaataryascggcacaggtggcagtgcttcaaccagcccaacggtcaaaatcaccgctggcggtggaacatttacctttggtgacaatggattagatttaggtaataaaaaaatcactaaacttgaaagcggtttaggattaacaaatggtactagtacaggtggaagtactgtaaacggaaatgctgacattattaaaaaaatcctcgaaggaaatcctgacggcacgactggttcccctaaaattgccaacaacgccgtgaatgtgaaagacctgtccgaagtcgctaaagcgattgtgactaaaggcttgacctttgcagggaatacaggcgatgctaaagcctcactcggcgataaaatcacgattaagggtgatggaacgtatttgaccagcaaggcttcttcaaatggtggtaaagaaattgagttttcattgacggatagtacgaaaaataaagtcgatattatcaatgtcggcactaccaacaacggcgacaattcctttgcgttgggtaaaaattcaaaactagagacgaaaaagaccgcacctagtgaaattataccgaatgcaggaaaagatgaagtcaaatttagctggacaacagcaggggcttctaaaactacaaatcctgttgatatgaaagaagtcattagtgttggtgatacaaacgctgaacgcattattacgcacgtcgccgcaggtaaagtcgataaaggctcaaccgatgcgattaatggtggacaactaaaaagcgtaatcgatgtctttgctaatttagggataaatgtattgggtgcggagaaagccgaagctgacaaagacggctttaagaaaactacatttaccgaattgaaaaatacaagcggacaaaacggaacggctaaagacacatttaaatccgctatcaatgctaatattgacaaaatcaacgaggggttgaaatttaaaggagatactaacaatggaagcaacggcgagcaacaactctacctcggttcgaccttgacgattaagggagcggaaaccaccgcacaaacatctactcaaggtgcgggtgcagccaaacatcaaaacattaccactaccgccaaaaacggtggcatattggaaatcgccctgaacacgaatttaaaaggcattacctctatcgggaaagatggggataatgttttaacgtttgcaaatggtacaagtggtggaaactcagcggaattaaaagtcggtggagcgtctttaacattcactaaatcagatgatggtgacaaagtcaaaattactggcttggcagatggaaaaagtgatggcgatgctgttactgtcaaacaattaaccgcctcaaaattgcattatttatcggtaaaaggaccaaatggaactcaaaacggagacaattacaacaatgacggtgcaaaagcccaaaattctatcgccataggtgttagtgcaaaagtggaagatcacacttcacacgattccgttgctatcggttatcaatcaaatgtaataaatgctaaatggtcaactgccgtaggtgcaggtactcaggttaaatcaattcaatctttggcgttggggtatcaagcaaaagtattggaaaagagtgatgcttcaatcgcaattggtgtatctgatacaaaaatagaaaatgctaaatgggcggtggcattaggaaacaaaataacaatatcccgttccggtaataatgttgttgcaataggaagtaatattaatgtaggaagtggcaacgatgatttaatcgtaataggaaatagaggcgacagttcaccacaaataacaaacgccaaaaactccgtcattatcggcaaacaggcaatttctcaagcggaaagtgcggtagcgattggtaaaggagcgactattgaagccaatgccacaggtgcggtagcgattggggagggtgcttctgtctcagaagacgctggtgattctgtagcaataggtaaaaattcagctgcagaagcgaaaatgtttgcaccggacggaatagacgctaatgttggtagtcagtcgttgaaaatcaattggaaagacgcaggtgcttcagctacagataaagattataaatccgtgttcagcataggagatgctggtaatgaaagagtaataacaaatgtagcagcaggatatgtaatagatgggtcaacagatgcagtaaacggcggacagttatatagtgtgatacacacatttggtaatttggcaagtgatgtacttggtgcagaagttaatactgatacggataaggaggcagatggaacacctaagtatggcttcaaaaaatcaacgtttgttgcggtgaattataaggatagtacaaaacaagcgaaagacacattcaaaggtgcaattgatgaaaccattaccgccattaacaaagggctgaaatttgccggtaatactggtgaaaagcaacttcaactgggcgatactttagcgattaaaggtaaagaagatagtgcaaacagctcccataaaaacatcagcacagaagcgaaagacggtggtattttagaaatcgccttgaattcagagttgaaaggtattcaatccatcgctaatggtgataatgcaaaaattgctttggataaagacgcaaaaaccattaaatttacctcaggggatacaccgacagaggttagtttaaaagctagtaccttgagcggtatcactgagattaataaggcaacggacaagggggcgttaaaactcactgagaacagtgcgaccttagaaagcacgaaagacaattcaaaacttgaattgaaagacaaaacggcgactttagaaagtgcgaaagataagtcaaaacttgagttagcagaagacagtgcaacgttaagtgcgggtaatggtaaaggaagcattaaagttagcaatggaatatctaacaaaatcgagttaagccctgaaaatggctctacaktgrmgyttrcaaaagacacggcgaatggtaataaagtcaaagccactggtttatctacmgtyggtaaagatgagaryaacgctttagtgtttaaaaatggtacgagtggcacaagtggcacgaacacggcagagttaaaagtgggaggtgcgatgttaacatttacgccagygaatggaactagaactgctcaaaccgtgaaaatctctaatgtggcggttggtaatatagmrastrrttcawaagatgcyatyaccggcggacaacttcatgatttagcargtaaattaggggttgmkgttgatagctcaggwaaaactrcgtttacagcaccatcatttaatccgataaaaggtggtacaactccaacaacctttaaagrkgckattrakcarttaatcacsgcsgtgaatggtggcttgacytttaaaggsaatgatacttcyycaasywmaaccacattrcaattaggcggwacrttgaccattgayagytcrmctgttrgtagcggtgctaatggaacgactgaaaaagacatcaccgtatcattagcaccaaatggtaacaatgctaaagatgcgggtacacttacgctgaaattaaataaagcgataaaagtggacgaaaacgatggaaaagttgtgacctctaaagcggtagcaacagagttgaaaaaatatacgacaacagctgatttagataaaggctatctcaaagtcgatggttctaatattggtgaagatgaagagaagaagaaacaaggcagaaaaacattcggtagcaatgtcggtattgctgaaatcaagttagatggtgaaaaaagcagcactgaattagtacaggcggatgcggttatcaagtatctaaaaggtaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgaaagtgcaattgctatcggttatggtgctaatgctaaaaatagaaacgcacttgccttaggcagagatagtgaggtattgggcgagcatgctacggctattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaatattcaattaacgttagaagagggcgaaaaaccggcaaatggtacaacgtctaccattaattcaagtgcggtaacttctaccccagcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacaccaccaacgacaacagctgtagtcaccattggcacgaaaaatgatttaaccaatatcacctcgatttcctctaaagctaaagctggaagtgcggacggaaatgatgctggtacaactggagacgtgactaaacttaccttagatcccactgatggggcsacwttccaagtcggcagtcaaggttctaaagtgaagattgataaagagggtatgatactcaccccacaaggagcgaatggtgcagatggggcgaaagatccatctgctaacgctccgtctattaccattaacgcaggttctgtaccagttgctccaaacagttcagcacaacctgctgatccaaacttgcctgctgttgataacggaccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcaggtgtggctcaagctgttgcacaagcgaacttgccggtcaatatattaccgggtaaaagtacgttaagtttggcgaccggtaactatatgggtacgcaagcctttgcagtaggttattccagagtgtccgataacggcaaacttagcgtcaaattcagcttaggacatggtgataagaaaacctctgtgggtgcaggtatcggttatagctggtaattcttgacttttcatccatcaaaaaagggcgtttatacgcccttttttctattagtgtcgatattttttgtcaatctaaccgcactttttgtaaatactaaattaatttaagcaatacctttatgtcgcagtagtgcatctaattgaggctcacgacctctaaagcgtttaaatagaatcataggttcttccgatcctccacgagttaaaatttcatctaaaaatgaacgacctgtttccgcattaaaaattccttcttcttcaaaacgggaataagcatcggcagataaaacttcagcccaaagatagctgtagtatccggcagaatatccgcctgcaaaaatatgactaaagctgtgaggcgttcttgcccaatcgacacctttgacgacagctacttcagatttaacctgttttaaggtcgctaagatttgatttggtttattagcttcaaaataatggtgtaaacggaagtcaaataaaccgaattctaattgacgtaaaacaaacattgccgcttgaaagtttttcgcttttagtaattgatctaatttttcttttggtagtggcttgccggtttcataatgtcctgagatgaatgctaacgcctcttcttcccaacaccaattttctaaaaattgacttggcaattctactgcatcccaaggtacaccattaattccggcaacatcagcgacatcaatttttgtgagcatatgatgaataccatgtccaaattcatggaatagggtagtgacttcgtcatgggtgaataaagcaggtttgtcgccaatcggagcattaaaattacaagtcaggtatgcaacaggtttttgaattgaaccgtcagctttacgttttcgtccaatacaatcatccatccaagcaccgccacgtttattttctcgagcataaagatctaagtagaaacttcctctcacttcattcttttcatcaattaaatcaaagaagcgtacatctttgtgccaagtgtctacgtcaaaacgctctactgctcgaatattgaaaattcgtttaattaattcaaatagacctgaaataacttgatcttctggaaaataagggcgaagttcctcatcattaattgagtataaatactgtttttgtttttcgctataaaagctaatatcccaaggttcaagtgcggtgatattgtaatttttttggcaaaattcttgtaattcggtcaattctttctcgccttgattttttgaacgttttgctaaactttccaagaaatcaataacttgttgtggagtgtccgccattttggtcgcaagggaaagctctgtataagtattaaagcctaacaaatgagcaagttcgacacgcaaagtcaaaatttcttgcataacatctgtattatcccattttcctgcatttggtcccagttctgaagcacgagtagcaaaagctcgatacatttcttctcgtagttctcggttttcacaataggtcatgacgggtaaataactagggaattccaaggtaaaacgataaccatcaagccctttagattgtgcggattgttttgctgcttgtaatgcactttcaggcaagccaattagatcttgttcattttcgacgactttatcccatcccattgtcgcatcaaggacattattactaaatttagcgtttagttcagataaacgagcaacgatttcaccgtatctttgctgtttatcttctgataaggcaatacccgataattcaaaatcacgcaacgcattttctatcgcttttttttgtgcaaccgtatattgggtaaattccggactattttttagttgcacataggcattatataaccctttatgttgccctaaccaagtactatattctgaaatcagcggtaaacaagcttgataagcggcacgcaattcaggactgtttttcaccgcatttaaatgagaaacaggcgaccaagcacgaccaagtttttcctctttatcgtttaggggttgaataaaattctcccatgtaaagtgcggttgttttaacacttgttctaccgtttcacgattttgttggatcaattgctcaatcgccggttgaatatgttcaggtttgatttttgaaaattgtggaagttctgaatgagttaatagtggattagacataagtgttcctcaaaatagacagttattttatataaaaaagtggtaagtagattgggatttattctagaaaatcaaggttgaggtctaaaaaatgtgaataattgaggggtattttattaatagttcataggaaaatttttattttgttttcattttatttttcatatcttattttgtgtactagatcacaaaaaagaaaaaaagtaaattaaatattaaaattaataatttaaaagattaatttcaatagataaacttacttaaagttagaaaacaggggaattccatgaaagagttatctgtggattgtattattgagcggagagattgtcatagtgctaaatgggaattagcaaaaaaatatagtgaagatattattcctatgtcggtagctgatatggatattccttcacctagagagttaatagagtatttaggaaagttaaataaaaaagggatatatggatatactatttttcctaataattataaaaaaataattcaaaaatattttttaagacattatggaagttatatagatgaagaaagtatagtattttgtccaagaataatacaggctgtttctatttatatcagagagtttacatgtataaatgataatatatctattttatcaccttcttataaaccattggtaaatgcaatttctttaaataaaagaaatgcaattttatgtgatttaatatataaaaataatcaatactatattaattttgatttgttagaagattgctttaagaaatcaaaagtatttatatttatttctccacataatcctacaggaacagtatggagtaaaaatgatttggaaaaaatagccatgttagcagaaaaatatggcgtttttattatatctgatgatatacatgcagattttaatttttccaacaataagcatatttttatttcatctgttagtgaatatgttgagaataattctattatatgtacatccccgtctaaaacttttaatattcctggattagaaatatcaaacttattaataaaaaatacctgcattagaaataaatttaaacatcacttagaagcattgggatttcataatccaaattatttttctgcatctgcattaataattacatatagtaattgtgatgagtggagaaaagaattattggaatatattagagaaaatagatctttggtgaaagatttttttgaaaaagagattcctgagttagaggttgttaatagtcaagggacatatcttgtttggattaactataaaaaattaaatctaaatgaagataaattaaaatattggctcattaacttatctaaaattgaaatgtcttgggggtctgatttcttaagaggtggtgaatatttttttagaatgaatatagctatgccaagaatagttttaatatcttgtttaagaaaaataaaagaaggattaattttgctattagaggaatcaaattatggaaaataatatgaaaagaaaaccgaaattattagaggcattatctccaattttatttatgctatttttattggggtgcggttatgcattttttgatttgccaccagagcctttaatgattctttcatgtgtatttgcaggtattttagtgaaaaagttagggtattcttataatgatattttagattcaatttcatttaaaatatctaaaactatgcctgcattattaattttaattactgttggcttattaattggaacttggatcattggcggtactataccaatgatgatttattatggattaaaggtcattgatcctaaatttatttatattacagcattatttctaacagcaatagtatcaatttgtacaggaacatcctgggggtcagcgggtacagttggtgttgcatttatgggtgttgcaattggtttggatgccaatttagctgccacagcgggtgccattgttgccggtgcttattttggagataaactttcaccattatctgatacaacaaatatagcttctgctgcaactaatgttgatttatatgaacatattgctcacttactttacacaacattaccatcttttctaatttctgctttagtttatattgtatatggatttaatattaatattgataatgtagcaacacctgataaagtattattgatgatttcagggttagaaagtatttataattttaatttatttttattgatacctgtaataattattttgtggggatctatcaccaaaaaaccaacaattccagttatgttattttcagcagttatagcatcatttaatgcaatttttattcaacatttctcattaaatgatgttattaatagtgcattaaatggatttaatatctcaatgttacctgattctttaaatattagttcagatcttgcccgtttactgaatcggggagggatgaattctatgatgggaaccttattaatttgtttttgtgcgttatcttttgcagggatactttcacttagtggtgcattagatgtaatcattaattacttattgagattagtgagatcaacggcttcattaatttttattactattctttgtggtcttactatgattggtgtgacttgcaatgggcaaatttcaatattaattccaggagaaatgcttaaagatgcttacattgacagaggtttacatcctaaaaatttaagtcgtactgttgaggattcagctacaattatagagcctatccttccttggactgctgcaggggcttatatggctggtactttaggtgttgccacattaacttatttaccttgggcaatcctttgttggagcggtattgtatttgcgatgatctacggtataagtgggattggtatcgctaaattaaaacaagagtaacgtaggaagaaaatacttaaggaattactcgtccttttaattaaaaccagtgaaaaagagcggttagttttagaaaattttatatgaagcaatttttcgtatttgtatggtgaagctaaagctcgatattattaaaggaagatacatggataacacacaaaaatattaccgcattgctttattgttcaacgccaataaggtgtatgatcgagaggtggtggctggcattggacagtatattcaagcatcgcaatgcacatggaatatttttgtggaggatgattttgtttaccataaagaaaccattgaacgactgtctattgatggtattattgcagactttgacgatcctgaaaccgtttccttgttgaaaaatattgatgttcccactattgcggtaggggggtcttatcagaattttgctgattatccgcactttccttatgtcgctactgataattacgctttagtcgaaaccgctttttcccatttaaaacataaaggaattagtcaatttgccttctatggtttgccgactcaaggcactcggcattgggcaaatgagcggaaaaatgcttttgtagatctaatggaaaaatatgcttatcaattttctgtatatttaggtgataaaactgattcaggcagttggcaagtggcacaatctgaattatgccaatggctacaaacattgccggcacataccggcattattgcagtcacggatgcaagggcaaggcatttattacaagcctgcgaatatttgaaaatagccgttcctgagaaactttgtgtgattggtattgataacgaagaattgatccaatatttatctcgcatttctctatcgtctgttgctcaaggtaccaaacaaattggttatcaagcagcgaaaatgttgcatagcctgttaagtggacataaagtgagattacaaccaattttaattcctcccttaaaagtagaagaaagggcttctacggattaccgttctttgcgtgatccttttgtgattcaagcaatgcattatattcgccaacgagcctgtcatggtattaaaacagagcaagtattggatcatttaaaaatttcccgttctaacttggaacaacgtttcaaattggaattaaacaaaaccgttcatcaaattatccatgaagaaaaacttaaccgagccgtgtatttacttcgctttaccgatatttctatgccagaaattgctgaaatctgcggttatccttctttgcaatatttttatgcagtaatgaagaaagcctatgggataaccccaaaggcttttcgtcgataaattactaaagcactaatgatttagttactgattgagtaaaatcagggttgaaaatctaaaaaaaatgagaataattgaaaactgtttttattttattagtaagctgtatgaaaatcgtttatttaagttttggttttatttttctcgcattaggtattcttggcattattatgccgggattaccgggttttccatttttactcttgactgttttttgttttagtcgaagttcggagcgtgtgcataattggtttttgcaaacaaaaatataccaaaagcatgttttacctttcaaagaaaagaagggaatgtacaaaaaaacaaaatacaatatcttgatttttgcgactgttatgatggcaatggctttttactttacacccagtgcggtcggaaaagcgatcattcttatcgccttggtcattaaatattggtatttcttatttaaaatcaaaaatttaaaaacttaactggtattgtccaagtgtttttgtataatgccctaaataatttaaataagtaacaaaaatgcctttttatttctttcgtatttatctttttttattactaaaaagtgcggtactttttggtgtatttctgttatcggcttgtaatgaaaaacaagagacgattaagactgaaaattttcaacataaacggtctgagcaaattcggttacaagaaataacaaaacaacaattaacacgaggggtttatgctgatttggtaatagatcctttattgttgaaaaaggaagaacagacagagattttgcgtgatatttttgaagggttgacaggctacaatgcgcagggcaaagttattccggctgttgcagaacattggcaaacggaagacaacaaaaactggatttttgttttgcgtgaagatgccaagtggtctaacggtgttacggtgaaagcacaagattttgtgaatagttggcggaagttggctttatccgataatcctttgaagatttatctccgtttaatgaatattagtaatgcggaatttgtcttaaataaaatcttgcccatagataaattgggagtttttgcctcaaatgaacgtttattacatattcaacttgataaaccgacaccacaattaccggcaatgttgacccatgctgttttattacctaaatatcaatcgacagataatgaatttataacaaatggtgcttatcaaattgctgaacgacaagaaaaacaaattgctttagcaaaaaatccttattatcgagaatcggaaaatgtttattttgatcgagttatttatcgagaaatttcccaaaatcaatcggttaactctttagatctcgttctgaatgcaaaatcatcgcaggaaaacttaatttatttgccccaattatgtgtttatttttatgaatttaatttttctcacccccatttgaaaaaaagtgcggttcgtagggcattaatttcaatggcaaccattccacaaacttttttttcagcgaaaatgcaagcaattcattcttttttgcctcattctttgcgattaggacaagaagacatttgggagccgactattgtggaaaaattattcgcagaaagccaaattacagaaaaattgccgttaaaattcacgttaacttacgataaaacggaaatacaagaaaacattgcaagaaaatttattcaacattggtcgcaatcagatttaattcatgtaagagcaaatccggtttcaagagaagaattattgcaacaacgggcaattggtgattttgatgttattcgttcaggctggtgtgcggattataaggaaccgtcaagttttttgcttaattttcattctaagagtccggacaataaaacaggctatcaaaatattcaagtagatcaattactggaaaaagcgttgcaatccgttgaggaaaaagaacgaaatgctttttacatggaaataataaaaattttacaacaagatcaagtagtattgcctatttttcagccttttattcccatttggcaaaacaacattttgggtattgaacagaacaatgatacaggtgtgatatatagcaaagatctgtatagacagaacaaagcaggcgagtgagaataccttatttccgcataaataacctatttaacttttaaacatattaaggatttattgtggcattaattagtttaaccaatggctatctttcttttggtgatcagccgttattagattatgcagaattacatattgaggcgggtgaacgagtttgtttagtcggtcgtaatggagcaggaaaatcgacattaatgaaaattttggcaaaagaagtcattatggacgatggcaacttgcaatttgaacgagacttgattatttctcggctggaacaagatccgccaaactatgcagaaggcaatgtatttgattatgtggcggaaggcatagggcatttagctgatctattaaaagattatcatcgtatttctctgttattagaaaaagaatacagcgaaacattgcttaaccaattagcacatattcaagctgaactggaacataccggcggttggcaatttgaaacaaaaattaaagaaactttagctaaattagatctaacaccggatactttgttggttgaactttccggtggtggttacgcaaagccgctcttgccagagcattggtttgtaatcctgatgttttattacttgatgagccgactaaccatttagatgttgaggcaattgaatggctcgaggaatttttgttgacgtttaacggtagcattatttttatttctcacgaccgctcttttatccaaaaaatggcgacacgtattgtggatttggatcgaggcaaattagtttcttatccggggaattatgatctttatttagttactaaagaagaaaatttacgggttgaggcgttgaaaaatgaactctttgacaaaaaactggcacaagaagaaatttggattagacagggaattaaagcacgtcgaaccagaaatgaagggcgggtaagagcattaaaagcattacgtgaggaacgtcggcaacggagagaagtactgggtaaagctaaattacaattagataattcaagtcgctcaggaaagatggtgtttgaattggaaaatgtcagttatgaagtggcaggaaagacattattaaaagatttcaccaccacgattttgcgtggagataaaattgctttggtcggtgcaaacgggtgcggtaaaacaacgtttatcaaattgttgttgggagaaattaaaccaacgtccggaacggttaggtgcggtacaaaattagaaattgcttattttgatcagtatcgtgcagatctcgatccggaaaaaacggttatggataatgtcgctgatggcaaacaagatattgaagtgaatggtattaaacgtcatgttttaggctatttgcaagatttcttatttccgcctaaacgagccatgacgcctgtaaaagcactttccggcggagagcgtaatcgcctgttgttagcaaaattattgcttaaacccaataatttattaattcttgatgaaccgacaaatgatttggacgtggaaacattggaattgttagaagaattattggcagattatcaaggtacgcttttaatcgtcagtcatgatcgtcaatttattgataatacagcaacagaatgctacatgtttgagggaaatggtgttctgaataaatatgtgggcggtttttttgatgcaaaacaacagcaagctaattattttgcttgtaaagcagaggaaaaagctaaacaggaaaaagttaaagaggaggaaagaggcgtaaattcagtcgttgaaaaaacggaatacaaaactcgccaagtgaagttatcttataaagagcggttggaattagagcaattaccgcagttattagaagaattggaggaaaaaatcaccgcacttcaaatggaaattagtgatgtgaacttctttcagcaaccgcatgaatatacttcaacaaaattacagaccttagcagatatggagcaagatttagagagggcttttttgcgttgggaagaattggaagaaaaaaagaatttagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatcacttcttactaaatctctcatcgcttcagcgttggcattatcagcgagttatgccaatgcggcagctttccaactcgccgaggtgtccagttccggtttaggacgagcttatgcgggtgaggcagcgattgctgataatgccgctgttgtggcaaccaacccagcgttaatgagtttgtttaaaacgaaacaattctcaatggggggggtatacgttcaatctagaattaatataaatggtgaggttaatgttaatgtagggaagggaattgtacaagttgcagatgaaaaagcagatcagaaaaaggttgtacccggtgcattagttcccaatttgtattttgtggcacctattaatgacaaatttgctatcggtgcgggtatgaatgtcaactttggattacaaagcaaatataaaaaggattatgatgccggtgtttttggcgggactactgagctgaattccattaatttaaatttaagcggttcatatcgtgtcagcaaaggattaagcgttggtgcggggttaaatgcggtttatgctaaagcaaaaattgagcgtcatgcgggggttctagataaggcaattgatactattgccgattctaagggaatggctgggagtatcaatattccttcattaacattgttagtcccaattttctcccagttaaaagatagagtgaatacggatactctcttaacacaattacaagataataatgcatggggattcggttggaatatcggtgcggtttatgaatttaatcaaggtaaccgtatcggtattgcctaccattctaaagtagatattaattttaaagatgatgatgcgttgagttatcaatttgaagcaggaaaaattagtcctgttaaagagaaaggtgggttaacgctacatttgccggattatttcgaaatttccggtttccaccaattaacggaaaaattcgccatgcactacagctataaatatactaaatggagccgtttacaaagtttacatgccacttatgataacggtaaggtcgctttccataaagatgaaaaatttcatgacagttcacgtgtagctctaggggcgacttataatgtgaatgataaattaaccctgcgtgcaggtattgcttatgatgagtctgccgaccatccgagtgcttcaatccccgataccgaccgcacttggtatagcttgggtgcaacctataactttacgcctaatctttctgttgatgtaggttttgctcatttacgtggtaaaaaacagcaatttaaggaaaagcataagattggaagtacaggtattgagttcggcagtatagatgcaaactataaatcaacagcacgtgccaatttgtacggtttaaatcttagctaccgtttctaacggctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacttgcaagagttattcttccaaaatctctgcaaaaatctgaatccctttgactcctagtgcggtggctagaccaacgaaatttgcaccagtggttttcattcgttcaaagccggctttgtcattaacaccgcccacaccaataatttgtacgtcttttaattttggttctttatccagcatttgacgcagagtatagacattgcctaatgataatgcgtgaattgctgttcctgccagtcctccaatacctgttcctgtttcagaatttaatatggatttcccctcttgcatcactaatgaagagccaagcgtattagtagaagtaataaaggaaatcggtagtgttttattttctgttagcgattttaatagtccattaattaattcatcatattggttttgataggtaaatggtggaattttaatgccaatcggtaaggcctcttctcctagacttaacttggctaaagtggtttgtaacgcatttaaataaggtaataattcttctgctgcataggcaggcgaaacttttccagccatattcgggcaagaaatattgatttccattgctaagggcatcttcacttctgtttgcagagccacgatttgctcatagcattctcccacttcttcaggtgaaccaaacacggaaataatgaaaggcttgttggaaatagtctttaattcatcggagatagtacgaacaaagcgaatggtagtcgctaaattattgggactaagtccaattgtatttaggctggtagtttgttgtggagtagcattgggggtattaacactggctgttttttgtgatgttgaatcaaataatacatattggttttttgtccagtcatgtggatagggaactagcatagacgtgcgagttgtaaccgcacctgtatattgacaagcataaagttcacgtaaattttctaattcggaacaccaagggcaaggggtatttaatagggcagggtgaatgttaagttttttcattttggttttctccataattagatcatagttaataaaaaaggacgctataaatagcgtcccggtaagttaagattaattcttttcagatgtaacaaattcaatagaatggtaactaaatcacaagatttgatgttttttaatgaaaatttatggatatatattaacatgttgctgatgcagaaaaaacattaccatagaaagagtgttgaacgtggttgagaaagtcaatcttttatttatacaagatttctaaaccacgttattaaactggggcggtaatataacttatttcagcaaaaatgagaagctaatttagctatattttatctaaaaattttagggtattagaattcagtcaaaattttatcctttgaaagagggtaatatgttaaacatcgatagaaaatggaaaagtgcggtaacaataccaaatagaataaccagtagaatagtgacgtttccgcctgcaaccataaacctttgtttaccattaggtaattgacgtgatttgtaagccaataatgcagggataatacaagcccaaattgttgccaccgcacctgcataaccgatagctttcaaaaaacctaatgggaaagcgactgataatattaatggaggaaggaaagttactgcccaagattttgttctccctattttgttgtcatcaaatttaaataagtcagccaagaagtcaaatacacctaaacctacaccaatgaaagaggatagaattgcagcaatggaaaaagcattaatagcttgtttaactgatgcagattcaattacatttcccaaagctttgagtaacacatctaaattgccatcacttgcaatcactggtgcaaattgatttcgtggcagattaccaaaaatggaaatgacccatagtaaatagagtgcaagagcaatggtggttccgcctaaaatagctaatttggctttatgttcatttttatagtatgcacgcattgttgcaacagagtggtgataaccgaatgatgttaatgcaacgggtaataagcccatagtatatattacataactattatctgagtcggtatttgtattaaataaaatggctaagtcaatatttttagttaagccaaatacactaagcataaaggaggttgtcataaaaataattaatataacggaaatgcgatcgacaatgcgagtagaatgccaaacaaagaaagagaatatcaaaacgaagataattgaccaaactcgagagtcaatgttgaacatttcatttgttaatccacttaggatgccacctgatgctgtagtataagcgtacagtaaaatacctccaacaaaataaacggataaattgttgatgatgttgacagtattacctaataggcttttggttactgtattaaaagaagctcgtaaatcaaaatgtttataagcctcaagtaataaccaaccggataacgtcatgcaagtcatcgtaaatccaatggtgaggacagaccaaatagtccaagctcccgcaccagatgtaggtaagcctaacattccggcaccgacacagacactcgcaataatgcaagcgccaccgaaaatagaaggtgatttttgcataatatatctccttttgaaaactataaaaaaacaccgcactttttgttaaaagtgcggtgccaaatttaaatctcttttaatcgagcggtgaaatgacgcagtactttaggttcataagtaaaatctaaccctttgatattttttgcattctctttcactcgtttgaatgcttcaataatgaagtccatatgtgtttgagtgtaggtcgcacgaggaatagttaaacgtaacaattcagccgggcaaggtaattgttgacctgttttcggatctcgtcctaataggagagaaccgatttctacggatcgaatacctgctactttatataattcacaagcaagagcctgagcagggaattgttctgctgggatatgtggtaataatttgcctgcatccacaaaggcggcatgtccaccgggttgttgacaaacaacaccgatcttttctaaaccttgtacaaggtattcaatttggctaatacgataagctaaccaatcttgacgcataccatcacgtaaacctacagctaggcgttccattgcaccaccttctagaccaccataggtagggaaaccttcttgtacaacacaaagtgtacgacactcgttgtaaacatcttccattgaattatctttgaagcagagtagtcctccaataggtaccattgcatctttttttgcagacatagccaaggcatctgcatatttatagctttcgtaagtaatttgttcaatagtccaatctttgtattctgcttcacgttgttgaataaagtaggcattttcagcgaagcgagccgaatccataatcacaggaatatcatatttacgtgcaatttggtacatggctttcatattggcaagagataccggttgtccaccggcagaattacaggtaatagtacatacaatgtaaggaacattatttgctccaacttctaaaataccttgttccagtttttctaaatcaaaattacctttgaaatcatgatctacatctgtgtcaaaagcttcttttatatagacattacgtacagttgcaccatttaattggctatgaccttgagtagtgtcaaaaaaatagttagagaaaacaaccattttatttcgatccaaccctttttcttgctcacgttttttgatcaagacaggaatataaatttgttctgcaccacgaccttgatgggttggaattgtgtattcataaccaaagatttctttcactgcattggcaagagcatagtaactgcgacttccgctataagcttcatcacctcttagcatggcagcttgcatatcttgagtaacggcacctgtaccactatcagttaatagatcaataaaaatatcttcactgtctaataaaaatagattcatacctgcttttaagatagcttcatcacgataggcacgagttgtacgtttgacaggttcaataacacgaatacggaacggttctggtaaatgtttgaaattttccatgattaaatcctcaaataattgattaaaaaatgtatattacaaaaatattattaggattgaggagttatgggaaaatacagggatagctttggatctacaagtatccaaacttgatttggtgataaaacatttaccatagcttatccctttttagaaatgaaatgtaatttatctcagacgaggaagatagtaacttagcaattgcactttgtcatatagaatgttttaaatttgtgaactaagtcaaaaattttgataaaaaataagactctacttatagagtcttatttttatgaaagtgcggtttgtttccgcaaatttttattgtgtcgcttgaattgcagttaatgcaatagtatacacaatatcatcaaccaatgctccacgagataggtcattgaccggcttacgcataccttgtaacatcggaccaatagagattaaatctgctgagcgttgtactgctttataggttgtatttccggtgttgagatctgggaagacaaatactgtcgctttaccggcaaccggagaatttggtgctttagattttgctacatcttccattactgccgcatcatattgtaatgggccatctattaataaatccgggcgtttttcttgggcaatacgagttgcttcttttactttctcaacatcagcaccggaacctgacgtgcctgttgagtaagagatcatcgccacttttggatcaataccgaatgcttttgcggaatcagcagattgaattgcaatctctgccaattgttcggcagttggatcaggattaactgcacagtcaccataaacaagcacttgatcaggtaataacataaagaagattgaagaaacaattgagttaccaggtgctgttttaatgatttgcatcggtggacgaatagtattcgctgttgtatgtatcgcacctgaaacaagtccatcgacttcgttagcctcaagcatcatagtgcctaatacgacggtatcttctaattgctctcgtgcagacgtttcagtcatacctttggctttacgtaattctactaaacggtctacataattttcacgtacagagacaggatcaattattgtaataccttttcctaatacaacgccttgagcatcagcaacacgtttaacatcatcaggatttgctaataagatacattctgcaataccacgttctgcacaaagactagcagctttaactgtacgaggttcatctccctcaggtaatactattcgttttttggctgcacgagctaactcagttaattgaaaacggaatgcaggaggagataaacgacgaggacgagttgaggcggcaactaaattttcaataaatgaagatttaaattgttggcttgtgtattgtttaatgttttcgatgcgttctttatcatcaacaggtacttcaaggttgaagctttgtagagccaatgcactttgccatgtattaccttcaattcgaaaaataggtaagccggtattttcaaatactggttggcatagttttttaatttgattgtcaattttgtaaccacctgtgagtaaaataccacctagctcgatcccgttagtcgcagcaagtgcggaggcggttaggacatcaggacgatcagcggaggtaactaacagactacctgttttgaaatgctcaaccatattttgtaatgaacgagcacagaaagtaatactacgaatacgacgagttttaatatcaccctcatgtagaatagaagcacctaaatgattgaccaaatcaatagcacgagttgcaataagctccgcattccacggaacgcaagctaatactttaatagggcttttttcaaatagcttgtaaacctcattaaggttattttgtttatgttggtaagcatcaaaaatttcacttaggtctggacgagtacgtccggattcatcaattggggcattaaatttattaattatgacaccaagtaagtttggattattttttccgccaaattgggaggccgccgcttcaatgcgttcttttaactctgccggcgtttctgttgcaggtgctgcaactaatacgatttcagcatctaacgcctttgcaatttcgtagttgatactgtttgcatagccatgcttgcgagttggaactaagccttcaacaataatcaattcattatttttagctagttgttgatgattttcaacaatcttttccagtaacacatcggattgattttgaccgattagattttcagccacacttagcataaacggttcggctgtttcaagtgttgtactggtacgcacaattgaagtagtgcggtctaatttatcttcatcggtacttggttgcgaaattggcttcatgaaaccgatttttgcccctttttgctcaagagcgtggattaaacctaaacttacactggttaaaccaacaccggtgctaataggaataaggataattgtacgagacataaaaaaaccttaaataatgttgttaaaaaagaaactgccgaatttatcggcagcctgtagattacaattagaaacttaaacgagcagtatcttgtgcaattacaagttcttcgtttgttggaataacgattgcgattggcgtattatccgctgtaataacaccttcattaccaaaacgagctgctgagtttttctcatcgtcaattttataaccaaatagttttaaatgatttaaagtaatttgacgaaccaaggcggcgttttcaccaataccgccggtaaagacaatcgcatctaagttttcgccaataatagccatgtatgaaccgatatattttgctaaacgatagcagaatacatctaatgcacgttttgcagcactttctttttcatagttatcttcagaataacggcaatcactcgttacttctgttaaacctaacaaacctgattttttaactaaagtttcctcgatctgtgccactgacatgcctaacgtattgtgcatgtaaaaaatgattgctggatcaagatcaccggaacgagtacccatcaccaagccttccagtggagtaaagcccatggaagtatcaatacatttaccttggcgaattgcagcaacagaggcaccgttgcctagatgacaggtaattacgtttattttatcttcagcaatatttaaacgtttggcagcttcacgactcacgaaatagtggctggttccatgcataccataacggcgaacgccatgttctttgtataaagaatatggcagagcgtataagaaagcttcttctggcattgtttgatggaaggctgtatcaaatacggctacgttgttatcttttaaatgaggaaatgctttaaatgcttcttcgataccgatcaaatgtgcagggttatgaagatgagcaaattcagcagcatctttaataccttggataacttcatcggtaataacaacagatttggtatatttttcacctccatgaacaacacggtgtccaatggctgcgattgaatttttaagatcttcagttaagatagttgaaacgataaagtttaatgcttcactatgtgctgcaccggcacctaaatctgcattacctttctcaccgttaagtttccacttaattcgggcatccggtaggtagaacgcctcggccaaacctgataatttttcagcaccagaaactggatcaagaatagcaaattttaaagatgaactaccgcagttaagaattaggactaatttttgagacatacgagacctattttgaaagttaagttaaaaaataaattcatttactcaacaatattccaagtaaatgaactgacatgaaagtctttgccctgcatagaatacacttttcagataataaaataaattggtaaaatcaaaaaatacgacttttatcaaaaaatgtatcaaactcatcgtttaattttcttgataaaaataatagatttttttataaataattctaaacgaatatgtatcaaacactaaaattaggtcaacgttatttggaaacttggccttcaatacctaaactgagtattatttttcctgaaaatcgagttattaaggtaacattatttgcacaaaaatttatgccgtttttagcagtattttcattagtttggcaacaagtttatataaaacatgatttggttgctttagctattgcagttttaaccgctttgtttgcgttgagcttgccattacaaggtctatattggctaggtaaacgttcaaagttgcctttacctccacaaacaaaggtatggtttgataagatagttgaggtgttacagcaaaaaaatactaatcttgtttctattgagcaaccaacgtatcaggatttggcagagttattgcgtaaagctgaacagaaattagatactgagttttggcagagtatttgagcgaagtttatcgctaaacagcaagtgatatatctaatggggtgaatatagtaaaattttccccgcacttgggtatcaagtagcttattttttcactagataaggaaagaaaatgctttgtgctatttacaagactaaaagaaaagaagggatgtatctttatattgaaaaacgggggtattttgattccgttccatcttccttacttgagtcattcggcaagccaatttttgtgatgttatttaatttagcaggacaaaaatcattgattaatgctaacaatgaagatgtgcaacaacaaattaaacaaaatggattttatttgcagatgtcaaaacagcaagaaaatttacttgaacaagaaagacagtatcttaagcacaataaatgacatgatcaatgatatgattttttaaaatttttaccgcactttgacacttttgaaaaaataaaggcgatcatagatcgccttaaatgtataaattatgctacacagactgtttcggttggtcaaataccgtcactttcggtgcggcttctgtgtatttttccacttgaacaatacatgtattcggggaattaccttgtgctaattttgaagtaccttcatcacgtgtcagtacgttggcacaaccatttttacacaaaggttgttctgattgacctaaatcagccggatcataccaagccccctcatgtaatgcgaccgtacctttaataattccttcagtaactaccgcacctgccaatacttgtcctcttttgttgaaaatacgaacaatatcaccatccatgatgccacgagccattgcatcttctttatgaattaacacaggttcacgatcgtttactgcatattttttccgtaacgatgtgtgagccaattgactgtgtaagcgatagtaaggatgtggtgtaactaatgctaaaggggcttccgtcgttgtattacctgcaaattcttcaggaacaaaccaatatggatgacctttacaatcatcataattcatttttgcgacaacatcagagtaaatttcaatttttcctgatggtgtaccaagtggattcagtaaaggatcattgcggaatgcttcgtaacgtacccatttttttgatttttcagttggtttaaagttaacaggtttattttcttgccagaatttttcaaatttcggcataagtacacgatttttacgtgctgcattaaatgccacgttgtaaaaatcttgcaaccattccatttccgtttttccttcagtaaatttgtcttctactcctgcacgtttggctaattctgcaaaaatatcatagtcatttttcgcttcaaattgtggagggacaacttgtttcattggaaaaatattcatcatggcataatcaccggacatagttaagtcgttacgttcatagctcgttgtggctggtaatacaatatccgccatgcgagcagtcggtgtccagttaacttcattgacaataacagtttcaggtttttgccatgctttcactaatgtatttgtatcttggtgatgaacgaaaggattaccacccgcccaataaattaacttaatgtcaggataggtcactttagagccattataatcaattgtttttccgggattcagcaatacatcagcaatacgtgctaatgggaaagagaattttgatgtatcatcaagccatgttttttctccggcttgtactgatggattagctgtaattgaaccaataataccaccgactgcagaaggtgcaccaccattagaataatgataactgaaaccaaatccgcctccaggtaacccaatttgtcccagcatcgccgctaaagtaactaatgtccagtgagtttgttcaccatggcgttgacgttgcataccccaaccgcccattaacatagtacgttttgacgaaaaatcagctgctaactgtttgatgatatctgcaggtaacccacaaattttgcttgcccaatttgcgtctttcggttgaccgtcagtttttcctaataaatattgttcaaatttatcatagccagtagtgtattttttcaagaatgccttatcatgtttatctgtagtaaccaacgtatgtgcaatccccaacattaaaggaacatcggtgcctgtatgcacaggtaaccattctgcatttaagaattcacagctttcacttctaaccggatcgatacaaataatacgtttaccgctttctttcaattttttgaaatattcaataccttgttgatcggtagaagtccatgcaattcgcaaagtcgtaagaggattagccgcccataacacaacaatatctgaactttctaaaacggtttcccagctggtttgttgttcataaacttcaattgtacctaatacatgaggcataattacttgtgccgcacctgttgaatagtcccctttgactccgacaaatccaccggtaacattcatgtaacgctgtaacaaagtacggctagcatgtaatgcacctgagctataccaaccataagaaccggcaaaaataccgcctgcaccataagcatcacgaacacgtttcatttcacctgcaactaaatcaaaggctttatcccaagaaacacgaacccattcatcacgtccacgcaaactggtatctttattaccctccaaaaatcctttacgaaccattggatattttacccttgtttcactataaagttggtcagctactacgctttgtaattcattttcgactgaaattggcattgcagatcctgatttaactaccttgccattttctacaactacacctaaagccccccaatgagcagctgttacaacggtatgttgttcagccgccacagctttcgaagctaatgttccgacaacaccgccacttagagatacgccagccacgcctaatgatgaattttttaaaaaatcacggcgacttgtattaactttattttgtgttttcattttaaacctcgttatttactaggctcacaatgaactggtgaaagaaaagacatcgaaacggttagaaaacacaccgcactttctccaacacattgtgaaagttttattttcgacacctttctaaagggagtggcacaaccatttctagttataccatgtgcaacatttgacaatgttacaggcttgcaaccttattttgcaacttaggtcaacaagctcggagtcgtcagttttttcaaaaatttcagcgtttcctttaagcgtagcttaatggcttttttcgccaaaatctttggcattgcgttgtaaatagattgttacagatcgtacgtcatctgctgtcattgatgtacgatctttcatcgaatttacaacaccaatccattgatttgcagtgtaatgatctgccccaattggtgcatgacaaccactacaatgagtttgatttaaattatttccaaactgatttaatgcctctaaattagacgttagtgcattttttgccacgtttatttcaaacgtaacctctttccactcagaatctgtgactttgtcatgaacagtttgcaacacgttcacatttttctcaattccatcacctaaagccaacataatgcgttgccctaattgtgcatagactattgtttccgcccctacttgttgccagccgtgaattgtgccgataacattgtcatcttgcaatttccaatcattcacttctgcaaacggcattaaccgcacttcatcgccttgtgccagctgtgccggactcattgccaaactatataatattttatcggtttgcttaaattctcctgcatgtttagttaattcaccatatgcggctgtatcatcaacctctatttcaggcataaaatgagcaatacctttatggcaatcaatacaagtttgatttgtttcgatgccggttttgtgcattttttgtgctgtcggtgtttgcgaagacatttccattgcttcgaaactatgacaactgcgacaagtggcagaatctgattcttttaaatcttgccaaacggacttcgccatttctaaacgatgcttttcaaatgcttcttcatcaggcaatttatcagtaacataagtatgccaaagatctttcactgcaaagacttttgttttcacataatggaaaacgttatcttgcgggatatggcaatccgcacattcggcacgaatcccttttcggttagagaaatgtatagaggcttcccattctgcttgaggttgttgcattgaatggcaagaaacgcaaaattcagtggtgctggttgctttcattgcatactgtactcccgctaaaataatcacccctaataacacaccaacgattccactaaacagccattttttatttgattttgccattcgcttttcccccaaaaataaaattcaataaatcaattacaacaaaaaaatcatactcttatattgtaacgatatgatgttggtaattcactaggcacacacgaaaaataacggctatttgcaccgctcttgacgtagatcaatatttaaatttaagagtgaatatgtgaaataaaatgcgtaattttatgtggcatttttagtattttctcccataaattgaaaggattgatatggtacaattttgttttttatcttatgcagaggaaaaggataggttcttttttgtgccactattaaagttaaaggagaaaagcaatcttgttgttttttttcactcaaattgacttgatcgagtatttcaaaatttaataattttatccaatcaaggatacgccaagtgaaatattgtctaaagggaagtgcggtttgatttttatgatttaaattttgtttgaaaatcaatgggctataagggttaaataaggaaataaagagataaccgtcattttctaaaactctggctatttcacctaataattgatggggatgttgcgtgaagtttaatgtattggctaatacgcaagcgtgaatagattgttgtacaaaaggaagttgtaatggatcagcttgtatcagactaatttcttctattacgttttgattagccggaaaaagtgcggtaggatttttcgtcatttccggcatgaggattattttgtggcgtaaaggtaaattgagttctaattcagcacttaatccgccaatcatgagccactgatcgcctaagactttttgaaaccaatctgcaaaaaattcgttgattaggctacaatacattgttcctttttgtatatgttgccaactcatcggcaatcgataattttttactgattttatgttgaagttcatattttctaacttgataccctttggaggagcttgatgttaattcctattcctgcacttaatgataactatatttgggtgtataaacgagagaatttatctgtaattgtgatcgatataccggaaatagctgcattatctcaatttatacaggcacaaaatttagtgattggagctttgctgatcacacataatcatagagatcatattggtgctttggctgaatttaagcagttttatcctcatgttcatatttatggtccggcagaatgtgccgatcaaggggtgacacaagttattgatgcaggaaggttaattattgatgaatatcatatagatgtattaccgactggcgggcatacggcacagcatcttagttttttggtagatggtcatttattctgtggagatactttattttctgccggttgcgggcgtgtttttacgggagactattcgcaaatgtttacttctttacagttactcaaatccttgccggataaaacaatagtttgcccagctcatgaatatacgttaggcaatttagcgtttgctttaactacaggcaaaaataaaagtgcggttcaaaagcaacttgaaaaagtaaaaaaactaagagcagaaaataatcccagtttgccgacaacattagcattagaaaaacaaattaacccatttttgcaagtcgagggtcttgaggaatttattgagttgcgtaaagcaaaagatgttttttaatttaaattagacattctattgtattaataggtaatcgaatttgctcaatgtgagacaatttattagaatagcgacgttttttacatgaatttcccaacaataaattatttatgaccattcttgttctcggtattaatcataaaactgcgtctgttgcactacgagagaaagttgctttttctgaagaaaagcacttgttggcattgaagcaaattaaacaaactcagctggcagaatgtgcggtgattttatcaacttgcaatcgaacggaagtgtatttacataataaaaatgttggacctcaaaatgatgaagtctggttagatagttgtgttcaatggtttgcagatattcatcaagtagatttagaagaactgaaaagttgtttatatagtcagcagaatttacaagcatctcgtcatttaatgcgggttgcttccggtttagattctttgattcttggtgaaccacaaattttaggtcaagtaaaacaggcctatcaaatgagtgaagagtattattcactgcattctgatattggcatgatgagtactgagttatctcgcttatttcaaaaaacttttgctacggcaaaacgagttcgtactgaaactcatattggagaaagtgcggtatcggttgcttatgcagcctgtagtttagctcgtcaaatttttgatagcttacgcaatttgaatattttgcttgtgggtgccggagaaaccattgaattagtcagccgtcatttattgcgtcatggagtgaacggcttagctattgctaaccgtacgttatctcgtgcggaaaaattggtggaaaaactggaaacaacacaaaagatagatatttttagtttagacagactttcggaagggttaaagagagcagatattgttattacctctaccggcagtcctcatgttttaatctcccgaaacttgattgaacaggcacagcaaatgcgtcattacaaaccaatgctgattgttgatattgcggttcctcgtgatgtggaggaaagtgcgggggaaattgaatctgtatatcattacactgtagatgatctacataatattattcaatataacatcaaccaacgtgaacaagcttctcaacaagctgaacatattattcagcaagaaagtgcagatttctttgaatggcttaaagtacatcaattttctaatttgattcgcaattatcgagaaagtgcggagataattagacaagatttactcgaaaaagccttgcaggctctgcaaaatggtgagaatacagagcaagttttacaagagttgagtcacaaactgactaagaagctgatccatcaacctactcaagctatgcaaacgatggtaaaagccggtaatacagaaggtttacaggctttttctcatgcagttaagtcctaggaaagtacaatttatttaagtttatccagttttgccaataaaataggtgctggttgttgttgaattttatacatacgccaaagcagtaaaatagcagcgattgttaaactcactacaaaagatacccaaaagccggcagcaccgatacttggaataatccagtcagttcttgataaggaaaatcctaacggcatgccaatgccccaataacaaaaaagggtaatgtataaaatagcttgtgtatctttgtatccccgtaatgcaccactggaaactacttgagctgtatccgaaaattgataaagtgcgacgagcatcagcagactacttgatatagcaatcacttctttatcatttacaaaaattgatgctatttcatagcggaagaaaaagatgatggatgccgtcaggaaagcaatagataaacctacagtaagagcagagaaagatatctgcttggcattatctattttgccttcgcctagacgttgaccaacaagaatagtagtagccatacctaaagacataggtaacataaatgcaaaggaactggtatttagtgcaatttgatggcttgctacaacttgagtaccgagaggtgataataatagtgaggtaagtgcaaataatgccacttcacaacataaagaaaccgcaataggcaatcctaaacgaaataattttgccaaagttttcgtatcaggtttttcaaataaatgttcaaaaaccttgagatcacgttgatttctagcatgcttactatagacgatcatcattaagcacattatccagttgacaatagctgttgcaatgccacaaccaaccgctccaaacgccggaatacccaatttgccgtaaataaaaatatagtttagagggatattgcatagtaagcccaaaaacgtaatgaccatagccggttttgttttggcaatgccgtcatttaagcaacggaagttaattaataataaataaccaggtaatccccataacattgcacgcaaataaccgatggtaatattggcaagtttttcttccattttcatatactgaatgacaaaatcgctattgtagattaataagccaagaggaatacagctaataaaaacaatccataagccttggcgtatttgatgagcaatatgatctcgttgtccggaaccatttaaataagagattgttggaggcaaggcaagtaataagccatgtccaaataatactaggggtaaccaaatagatgccccaactgcaacggcagccatatctgctgcactaacacgtccagccattattgtatctactaaccccatggaattttgtgctacttgtgcaagtaaaataggggtagcgatggcaattaattttttagcttctgtgtgatattgttgaaaacgagttaatttcataaaaatccgattttgctataatattggaaatatttatttagagagaactttatatgtttacaggaattgtccaaggaacagcacaaattcagtctattattgagaaagctaattttagaacacaggtaattaaaatgccacaggatttattagcaaatttagaaattggtgcatctattgcaaataatggtgtttgtttaacggttacagaaattaagggtgatttgattagcttcgacttaatggcggaaacattacgtattacaaatttaggtaatttagcggtaggcgattttgttaatgttgaacgtgcaatgaaaatgggggatgaaattggcgggcatattttatccggtcatgtttattgcactgcaacaatccaaaatcgtattcaagcagagaataatttgcaaatttggtttgaaatgcctacagctgaattaatgaaatatgtgttaactaaaggatttattgcaattgatggaattagtttaaccgttggcgaagtcaaagggcagtgcttttgtgtgaatttaattcctgaaacaattaaccgcactttgattgcaaaatatgatataggtgatttagtcaatattgaaatagattctcaaacacaggcggttgtggacacagtagaacgatacttggcaaacagataaattcattttgcctaaaatctaaaattgtgggagtgtactctcacaattttatctatttatagcgtttttttgtgctttgctcatctaaattatgcaatcgtgctaatttttctttaagttgaatttccagtccacgatctgtaggaaaataaaatttcgtatcttttaattcttctggaaaataattttctcctgccgcataggcattaggttcatcatgagcataacgatattctgctccatatcccaactctttcattaaatgagttggtgcattacgcaaatgtaccggtacatcataatccggcatttcttttgcgagtttttttgcttgtttaaaggcaacatatacagcgttacttttaggtgcaacagctaaatatacaatcgcttgtgcgatagcacgttctccttcagctgcaccaactcgagtaaaacaatcccatgctgcaagtgctacttgcattgctctcggatcggcattgcctacgtcttcggaggcaatagctaataaacgcctggcaacatagagaggatcacctccggcagtaataattctagcataccaatataaagcagcatcgggagcggagccacgaatagatttatgtagagcggaaattagatcataaaatcgatccccttgcttgtcgaagcgagcctgtcgttcccctaatacttcagttaggagacgatgattaatcaatttccctttttctgtttcatctgccatatcaaccatgagttctaaacaatttagtgctaaacgggcatccccattgacatattcagctaaggtttcaagaacattttcagcgaaaatcaaccgctcttttcccaatccttgctctgcatcttggatagcattttgtaacactgtcacaatattagatgtagttaaaggtttcaaaatataaactttgacacgagagagtaacgcattatttaattcaaatgatggattttctgtggttgcacctataaaaatgatagtgccgttttcaatatgaggcaaaaaagcatcttgttgggttttattaaaacggtgaacttcatcaacaaataaaatagtttgttgacccattaaacgattttgttttgcccgttcaacactttcccgaatctctttcactccggcggtaactgcagaaatacgctcaacttgagcatgaatttgttgtgcaataatctctgccagcgttgtttttcctgtaccaggcgggccccaaaaaatcatagaatgaatatgtccgttttcaatggctttatatagtggctttccagctccgattaaatgttcttggccacaatattgcttcagtgtttgcggtctcatttttgcggctaagggttgaaatgccgagtgagagaaatcaagtgaaaaagtggacatataaaactccattaaatgattaaaagtggacgtttattacgtccaatcatttcaattttaattaattattttttacgttgatcgtcaaattcaacgcccttaggcaaggtaaatgtgaatattgcatcatttaaggctggattggtaatcttacgcagaatatacaagttactttgcccatcgttctctattgtactaaaattttttaatacaccatctttttcaattcgaatattaaattgcttgatggtacttttcttagatttgggtttaataataaacgtatcggatttttgctcaacaatatattgttgccaatgacttggattattacttgttagcaaaacaaagggggtatcgcttaaggtatcttcaacccaatttgctgttacttgctcaacaaaaggatcgtagaaccataatgtttttccatctgcaataatttgactttcttgaggtgtttcattgtccatacgaaataaattaggacgtttgagttgtatttttccactaccttgctgtattttttttccctgtgcatcagtcacttgttgtgtatagtcagcacttaacacatcaattttatttaaacgattttgtaactcattaaccgcatttgcccaagttacattactgatacctactaataaaagtgcggttaaatttagatattttttcattatttgtccttttcaattgagaatgaattgattcgatataatcaaaaggctgaaatgttgtataacatatcataaaagataagtataaaccctaaaaaataaataatattccgttcagtttatgatactgtgatctagtgcaaagaaaaaattttttcgctagctataatacaacttggtagtttaacagtttatttgaggagtatttcttatgcaaaattgggcacctgaagtatggcaaagtgcattaattggtttatgtattggagtttttatcggttacttattattgcgtttcactaaaggaacggtcaaaaaacagataaaaacagaggctgagttggagcaagtgaaaattcaacttaacaatcagaaacgacaattagagcaacattttgctgaaagtgcagagttgttaaaaaatattgcacaggattatcaaaaactttatttacatttagctaattcatctacaacactattgcctgaattggcacagaaagaattattttcaccgcatttattagccacggaatctatttcgtcacaacaagataaatcaaaagataatcagcctagagattattctgagggttcatcaggtattcttaaagttgaaaaataactatttctaaataggcacattgaggtgcctattttgctgtttttctttaatctctttgcatttctgaaacttttttgtattttttctgtcttaaattagcgatatatatgatttagatggagaaaaaagtgaaaaaatctagctttgttttaaccggtattgctttagggttaagtgttctaacaacatcaattaatgttcaagcaagtttgcctatggcagttgatggacaatctcttccaagcttagcaccaatgttacaaaaagttttacccgcagtagtttctattgcggtagaagggaaacaaaaaaataatttttctttcaataatgaaattcctgaagagtttcgccgtttttttggtgacagctttggttttgaaggatttagcagtcgtgcaccgcggagttttcgtggtattggatctggagtgattattgatgcagaaaaaggttatgtattgacaaataatcacgtgattgatcaggctgataaaatcacggtcaaattagaagatgggcgtgaattcaaggcaaaggttcttggcaaggatgatatgtcggatattgcacttattcaattagaaaatcctaaaaatctgaccgcagttaagatcgctgattctgataaattaagagtcggggattttacagttgctatcggtaatccattcggtttggggcaaaccgcaacatcgggaattgtttcggcattagggcgttcaacaggatttgatagcggagcttatgagaactatattcaaactgatgctgccgtaaatagaggtaattccggaggaccattagtaaatttaaatggtgagcttatagggattaatactgctattatttctccaagtggcggaaatgcgggaattgcatttgcgattccaagtaatatggcaatcagtttagttaagcaaattattgaatttggcgaagttcgtcgaggattactcggtattaaaggaggtgaattgaatgccaacttagcaaaagaattcaatattgatgtacaacaaggtgcgtttgtgagtgaagtattgccaaattcagcggcagaaaaagccggacttcaagcgggtgatgtgatcacggcaattgatggacaaaaactggcaagttttgcggagttgcgtgcaaaaattgcaacaagtggtgccggtaaagaaattaaattgacctatttacgtgacggtaaatcgaaaactgcgaaagtgaaattgcaatctgatgatggagatacaatttctgcagttggcaacatttctatattagaaggtgcggaattaagtaattataatcaaaaaggcacaaaaggcgttgaaattaaagaagttaaatcaagatctcttgctgctcaatatggtttagaaaaaggcgatattattattggagtgaaccgccataaagtagaaaatttatctgatttacgtaaaattttaggcaaaaaaccttcagctattgccttgaacattttacgagatgacagtcgtttttatttattaatccaataattttactgaacctataattcttattaagacaaaacgaaatccgcactttaaagattgaccgatcaaagtgcggattttttgtgtttaaagatgatgttcttgtctaatttttttgagtaacgcatcgcagcatttatccagtaattgataagtctgctgaaaattgccggtataccaagggtccggaatatgatcacaagctaaatcttcacatatcgtggttatttgaaaaagtttagatggtgctttcgtaaagaatttttccaaatcatgtagattgttgttatccattgcgattaaataatcaaattgttgccaatcactattgcgaatttttcggctggtaaaccctctgttatcaatagcatatttggtaagaatctttgccgtttcttggtgcatattttctccatcatgccaaccggaagttccggcactatctgtaaaaatttgattatctaaatgagctaatcgaattttttcacgcataatatattctgccattggggagcgacagatattacctaaacagacaaataaaattttaatttgtggtttcatgttaagcctttgccttatgatgaataaaagtgcggttgtaattgtacatgttttgtgccaatttagataagtttttattagcaataatctatggtaatattcgcttcccctttattttaaaagtgactaatcatgtctttaccaaaatatgttgaacaactgttaaaagagaaaagtaatgttcgggtattctcgtttaaatatgatgggaaatcttattggctaaaacaaaccgaaaaactttcttttatttggcggttcttgaaatccaatccagcggaaatgttaaaaagtgaaattattcgcttacaagaacttaataaaaaatcagcacctgtacctaagttagttttatttggtgataacttttttgtgactgaagatgtgggaagtagtgcaaatacttgggttgaaaatgaggatttatctattgaattaagaaataaggttttgtttgattgtgctcaagcattggcaagcttacataaacaaaatattactcatggtcgcccagccttaagagacatgatttggtgtgaagaaaaagttatttttgttgattttgaatgtacctcgtcaagtaataacatagattggcaaaaaattcgtgatggattagtttttattcatagcttaggacgttcttcaactgtttcggatgagcaaatagcattgactgttactcattatcgtcagtattgtgatgctgatatttggcagaaaactgctgattttatctataaatatcgttgggcatattatgttcttcgtattttcaaacctgttgcaagaatggatttaattgctatttatcgtttatttgaagctattttaaaaaatcaggaaacattatgataaaaaaaagtgattgtatggagtatttgtgcggtttggtaatggcagtttaagtgttaggggcataataatggtattcgattttttattaaattgtttataacatcaacaaataacaataaattagtaattttatcttgctattttttttatgacagatataatgtgatgcatatttcggacgcggggtggagcagcttggtagctcgtcgggctcataacccgaaggtcgttggttcaaatccagcccccgcaaccactttacatagaagttttcgtaaaggaccccactgtgacttggggtttttttatgcgagtaaacttgagatttagtaaacgggctgatagccctttttttacatctgtttgttatgaaatgtagaaaaaaactcaatcttacgtgttattttgagaggagaggatagtggcaacattagaggataaattacaagaattattacaaccttcagtagaggatttaggttgtgagctttggggtattgaatgccaacgttccggacgtttttttacagtacgtttatatattgataaaaaagatggcggtgtaacggttgatgattgtgctgatgtcagtcgtcaagtaagtgcggtgctggatgtggaagatcctattgcggataaatataatttggaagtgtcttcgccaggcttaaatcgaccattgtttacattaaaacaatttgagaattatatcggacaggatatttctgttcatttacgtgttcctatgtttgaccgtcgtaaatggcaaggtaagttagagaaaattgaaaatgatatgctgactttgattgttgataatcagccacaagtattagtttttggcaatattcaaaaagccaatgttgttcccaaattcaattaattagagagacaaaaatgagtaaagaaattttattagccgctgaagcggtttccaatgaaaaattgttaccccgtgagaaaatttttgaagcattggaaagtgcaattgcactttcgacgaagaaaaaatatgaacaagaaattgatgttcgtgtagtcatcaatactaaaaccggtgagttttctacttttcgtcgttggttagtggttgaaacagtactcaatccaacgaaagagattacattagaagcagctcaatttgaagatccggaaataaaattaggtgactatattgaagatgaaattgattcgattgcttttgatcgcattgcgatgcaaacagcacgtcaagtaattagtaccaaaattcgtgaagcagagcgtaataaaattgtggaacagttccgttcacaggaaggtgaaattgtttccggtacagtgaaaaaagtaaatcgtgattctattattttagatttaagtcaacaggctgaagctgttattttgcgtgaggatatgttaccgcgtgaaaatttccgtccgggtgatagagttcgtggtgtactatacaaagtaagtccggaaaacaagggtattcaattgtttgtgactcgtgctaagcctgaaatgttagtggaattgttccgtattgaagttcctgaaatcggcgaagagttgattgaaattaaaggtgcctcacgtgatccaggattacgtgcaaaaattgctgtcaaaagcaatgataagcgaattgatccagttggagcttgtgtcggtatgcgtggctctcgagttcaagcaattaccaatgaattggggggagagcgtgtagatattgtgttatgggatgataatcctgcacaatttgtcattaatgcaatggcaccggcagatgttagctcaattgttgttgatgaagataatcattctatggatattgccgttgaaccggaaaatttagcacaagctattggacgcaatggtcaaaatgtacgtttagcaacacagttaactggttgggtcttaaatgttatgacaatagatgatttaaatgctaaacaccaagcggaagataacaagattttagctttatttatgaccgcactagagattgatgaggagtttgctcatatccttgttgatgaaggattcactaatttggaagagattgcttatgttgctgtaaacgaattaacggcaattgatggcttagaagatgaggatcttgttgaggaattacaagctcgagcgaaaaatgcgattactgcaaggatgttagctgaagaagaagcattgaaacaagctcatgttgaagaaaaattattaaatttagaaggtatgtctcgtcatattgcatttagattatcagaaaaacaaattacaactcttgaagaattagctgaacaaggtgttgatgatttatcagatattgaagaattaagtgctgaacaagctgcagatttaattatggctgcacgtaatatttgttggttcaattaggaataaagagtaataagattatggcagatgaaataaaaaaagaaaatgcacccaaaaagttgagtattcaacgtcgaacaaaaactacagtgagtggaacaagtacaacgggaaaaagtaaagaggttcaggttgaggtgcgtaaaaagcgtacagttactaccgatcttgaacgtaaagctcaagaacaagccaaattaaaagccaaagaggaagcagagaaaagagctgctgaggaaaagcttgctgaaaaagcgaagcgagaagcggaaaaagctaaagctgatcaaataaagatagagaaagctaaggctgaacaagctaaagcaagtaagaaaaacgttgatgtagaaaaagaaaaacgtcgagcggaagaggctgaattacgtcgtaaagccgatgaattggctcgtcagaaggcagaagaaaaagcacaaaaagcggctgaagaagctaaacgttacgctgattttgatgatagtgacaatgataacggtaagttggatgattatagcgattatcacttaacttccagctatgcacttgaggcagaaaatgaagaagaacgtcgtaatgaaaatcgcggacgtagtaaaaataaagtagttaaagctaagaaaggtgggcgagatgatgaaaatggtaataaaaatgaacgtcaatcagatcgccgtaaccaaaaagatgtaaaaggtaagggaaagcacgctaaaaaagccagtgcgttacagcaagcatttactaaacctgctcaagttgctaaagctgacgtagtgattggtgaaactattactgtggctgagcttgcagcaaaaatggcagttaaggcaacagaaattatcaaaaccatgatgaaaatgggagaaatggtaacgatcaatcaagtgatcgatcaagatactgcacagcttgtagctgaggaaatgggacacaaagttattctacgaaaagagaatgaacttgaagaaatggtcatggaggatcgtgatgtaaatgctgaaaaagttcatcgtgcaccggtggttactattatgggacacgttgaccatggtaaaacttcattacttgattatatccgcaaagcaaaagttgctgcaggtgaagcgggaggtattacccagcatattggtgcttatcatgttgaaactaatgatggcaaaatgatcacctttttggatacgccggggcatgctgcatttacttctatgcgtgctcgtggtgcgaaagcaacggacatagttgttttggtagttgcggcagatgatggtgtgatgcctcaaactattgaagcgatccaacatgctaaagccgccaatgcaccattggtggtcgctgtaaacaaaattgataagccagaagcaaaccctgatcgagtagagcaagaattactgcaacacgaagtgatttcagagaaatttggtggagatgttcaatttgttccggtttctgcgaaaaaaggcttaggtattgatgatttattggaagcaattttgctccaatcagaagtcttagaattaaccgccgttaaagatggcatggcaagcggtgttgtcattgaatcttatttggataaaggtcgtggtccagtagcaactattttagttcaatccggtacattaaaccgtggtgacattgtcctgtgtggttttgaatatggtcgtgtgcgtgcaatgcgtgatgaaaatggtaaagatattcaatcggcaggtccatcaattcctgtagaagtactaggtctttcaggtgttccggcagcaggcgatgaagcaacagtcgtgcgtgatgagaaaaaagctcgtgaggttgctctttatcgtcaaggtaaattccgtgaagtgaaattagctcgtcagcaaaaagcgaaactggaaaacatgtttagcaatatggcagaaggtgatgttgcagagttgaatgttattgttaaagcggatgtacaaggttctgtggaagccattgttcaagcattacatgaattatcaacggcagaagtaaaagtaaaagttgtgggttccggagtgggaggaatcactgaaactgatgcaactcttgcagctgcttcaaatgcgattatggttggtttcaatgttcgtgctgatgcaacagctcgtcgtgtaattgaaaatgaaaatattgatttacgttattattcaataatttatgaattactaaatgaaatcaaagcggcaatgagcggtatgttacagccggaatttaaacaagaaattatcggcttggctgaggtgcgggatgtattccgtcatccgaaattcggtgcaattgccggttgtatggtaactgaagggctggttaaacgtaacaacccaatccgtgtattacgtgataacgtggtaatttttgaaggagaacttgaatctcttcgtcgttttaaagatgatgtcagtgaagtacgtagtggtatggaatgcggcattggcgtaaaaaattacaatgatgttaaagtcggcgatcaaattgaagtctttgaagtagtggaagttaaaagagcgatttaatttgtaaccggtaatataattttgttggttgaattatagctaaagagcgagattatcatatattaagttgcttaatgtttttgtggataagaatgcccttaactttgttttttaaggttaagggcattggagttttatcatgttttagaagagcaactgcgtatagtggtaaaaattaggaaaactcaccgctctttttaaggtgtaatttctcaactctagagtgaatttaccaacattaatggagaaaaatatggcaagagaatttaaacgtagcgatagagtagcacaagaaatacaaaaagaagtagcagttattttacaacgtgaggttaaagatcctcgtattggtatggtcacggtgtcggatgtggaaatatcaagtgatttagcgtatgcaaaaatatttgtcacttttttatttgatcaagatgaaaatgttattgagcaaggtatgaagggattggaaaaagccagtccttatattcgtagtttattaggcaaagtgatgcgtttgcgtattgtgcctgaattacgctttatttatgaccaatctttagttgatggtatgcgtatgtccaatcttgtgacgaatgttgtgcgtgaagatgaaaagcgtcatgtagaagaataagcgaataaaaatatgagtaaaccacgtaaaaaagggcgtgatattaacggtatttttttgttggataaatctcaagggatgagttccaatgacattatgcaaaaagttaaacgtcttttccaagcgaataaagcgggacataccggtgccttggatccgctggcaacaggaatgttgccaatttgtttaggtgaggcaacaaaattttcacaatatttacttgatgcggataaacgttatcaagttatcgctaaattaggcgagcgtacagatacttctgatgccgatgggcaagttgtgcaaaagcgagaggtcaatattgatttagcaaaaattttgaccgcacttgagcaatttcgtggtgaaattatgcaagtgcctactatgttttcagcattgaaatatcaaggcaaagctttgtatgaatatgctcgtgcaggcattaccattgagcgtgaagctcgtccaattagtatttttgagttgaagtttattgactatcaaataccttatttaacattggaagtacattgttctaaaggaacttatattagaaccttagtagatgatttaggtgaagtattgggttgcggtgctcatgttactaggttgcgtcggattgctgttgctgattatccttataacaagatgatgacgttagaacaattgcaacaattctctgaacaggaagatttggatttattggatcaacatttgttacctatggaaagtgcggttattcgtttacctggattgcacttaacaaaagaacaggcaagagctgtaggatttggacaacggattaagtttttaaatgaacaaggcatacaaggacaagtgcggttaatttctcctgaaaatttatttttgggtgttgctgttattgataaaaacagcattgtccatcctcagagaatggttgttattaaacccgaataaatccaaccgcacttaagggcagatttattctgcccttgttttgtcaattaagctaattccgctcgtaattttttagtgaccgacatcatcacttcaagttgtgcaatggtctctgaccagccacgtgttttcaagccacaatctggattgacccataaacgctcttttggtacaacgttaagagctttgcgaagtaaatgttcaatttcttctgctgttggtacacgaggactatgaatatcatacacacccggtccaatatcgtttggatatttgaaatcaccgaaagcggttagtaattccatatcggaacgagaggtttcaatggtgatcacgtccgcatctaaagctgcaatagccggtaaaatatcgttaaattcagagtaacacatatgagtatggatttgtgtatcgtctgctacacccattgagcttaaacgaaacgcctctcctgcccattgtaaataagtatcccaatcggctcgtttgagtggcaatccttcacggatagcgggttcatcaatttggatgactttgattcctgctttttctaaatccaatacttcgtctgaaagtgccacaccaatttgcttacataccgttgaacgtggaatatcgttacgtacgaatgaccactgtagaattgttacaggaccagtgagcatacctttcatcactttcttggttagactttgtgcatattttgaccaacgtactgtcattggttcaggacgaacaacatcaccataaattacaggcggcttcacacaacgtgatccatagctttgtacccaaccaaatttggtgaaagcaaaaccatctaataattcaccgaagtattctaccatgtcattacgttccggttcaccatggaccagcacatctaaatccaatttttcttgttcacgcacaacaagttcaatctcttttttcattgaattttcatactcttctaaagagagatcgcctttcttaaacgctgctcgagcacgacgaatttcggtagtttgtggaaacgaaccgatactggttgttggtaagagcggtagatttagccaagcattttgtaatttgatacgttcaccaaaaggtgatttacgttgatcggcattttttggcaaattagctaaacgttcagctacttccggacggtgaatttcttttgaatttgcacgagcatctgctgctacttggcttgcatctaattctacatttaccgcattacgacctttttcaagagcggtttttaagacgcttaactcttgtactttttgtaaggtgaaagctaaccagctataaagagcagggttgttctcttgtaattgggtttcaacatttaaatcaaatggtgtatggagtaaggaacagcttggagcaatccataaacgctcacccagtttttcttttagtggctctaatacatcaagtacagtatttaagttagctcgccaaatattacgtccgtcaattacgccggcagacaataccttgttgtaatcttcgaatgctactagttgctccggagcacgaactaaatctaagtgtaacccatctactggtaattcttttaataaagtagcgtgttctgttactgaaccgaaataagtagctaataataatttcgcattcactttttcagataacgttgcgtaaacgtctttgtacgcattaacccactcttttggtaaatctaccgctagtgcaggttcatcaatttggatccactcggcaccttctgccacgagtgcgtttaaaatctctacatacacaggaacaagttgagcgagtaattcaaaacggttaaaggattcgcctttctctttccctaaccataaaaatgttaaaggcccaacaattacaggtttaacttggtgtcctgcaactttcgcttcacgaatttggtttacataatgtgttgggtttgctttgaattgtgtgtctttatgaaactccggtactaaatagtggtagttggtatcaaaccatttggtcatttcaatagcaaattggtctttgttacctcgtgctaattgaaagtactgatcaagtgtcaaatttttactatcgaaaccgaaacgagcaggaatagctcctgttgcgacttgaagatctaaaatatgatcataaaaggtaaaatcacctactgccacaaaatccgcattagcatcagcttggtgtttccaatttttttcacgtaatgccttagctaaatctaatagatcttgctcagccaactctttacgccagtaacgctcttgagcgaattttagttctcttttggctccaacacgtggaaaacctaaaacgtggaatgttgtcataactaaatctcctgtatggtaagtacaattttgaatagacgtctaaacgtctgtgttttggtataatgcaataaaagtctttaatgatgcaatctcataattttcacgttttgtatgaaaaaaattaataaaagagcggtgtaatttaggtaagattaatagaaaaaagtaatgagcatgaagaagttgttattgaggcggttttttatgggcttggtttagcctcttcaacaggtgcagatagaacatcccaaatagatggctttggctcttcgggaatgtcattacaaaaaaactgatcgttatttatccaaacaggaagctttttaggacttgagcaattccagtttccataagagtctataccaatccattcaattttagctggtgtttgtggatttaacatttttatttcagcacgagataaataatcttgatagatttttaatgcaccactcgcaccggttaattttgttgttacattatcatctcgccctaaccatacagtaacaacattctcaccatcaataccaacataccaagtatctcttgattcatttgttgtacctgtttttccggcaagtttaagtgaagcgtattgattttgtaagctacgagctgtccctcgttcaacgacttgttgcatagcaaataaggtttggaaagctgcttcttggggaacgacttgttgtggcattattgaacgttggtaaatcagattcccctgcttgtctgtaatactgtcaagagttgacaacggaatatgttttccttcattggcaatagtttggaataattctgtaacctcataaggggaaatagagtaactacctaacaaagttgaaggcacgttaggtatttttacattatcccaacccattgccatttgcatttcaattactttgtttaagcctactttcataccaatattaactgttggaatattgagcgagcgaacaagtgcatctattagcatgacggaaccactgtattttctatcgtagttacgaggctgccatggctgagttcctttgatacgaattgtaataggctgattttgaataagcgtattaaggcgaaattgctcaggatcagataacgccgctaagtaaattgacggtttaactaaagaaccaatttggcgacgagcgtgtaaagcacggttaaatcccgcatagtttgtctgtaaaccgccaacaatggcttttacttcacccattttataatcagcaataatcatcgcactttctaaatgtggatttttatattttcgctgtaattctgaaactgcttttatcacggatttttctgcatgttcttgttgtttcggatccaaagtagagaaaattcttgcaccggataaagaggaaagtttgttttcgcccagtttgcttcttaattcttgctgtagagtttgaataaatgccggatacttgcggttaatttgtcctcttttttgtacgccgagaggacgtttactgagtaagtcatagagttcattactaatcattttatgattgagcattaattttaatacaacattacgacgttctaaggccttttgagggttacgccaaggattgtatagtgaaggaccttttaccatgccaaccaacaaggcaatctgatccaaactgatttcccgaacaggtagcccaaaataaaaatggcttgccaattcaaatccatgaatttgtgtgttgccattttgtcccaaataaatttcattaaggtaggtttctaatatgcgatttttatcgtaacgaaaatctaaaatcaaagccattaatgcttcattcattttacggcttaatgtgcgttcgttgcttaaaaataaatttttaaccagttgttgtgtcagtgtacttccaccttgtacattatgtcctgctttgatgttggtaattaaagcacgaataatgccaagtaaacttattccatcatgttcataaaaatggcgatcttcggttaaaagtaaagtatcgatcaataatcttggataatgttgtagcggaatagctagacgttcttctctatctgattgcaacatcgcaataagttttggatcaagacgaaactcactgatggtttttacattgatcaggtcttcaataatagaaagtttattatcattattaaaacgtaggcgaaaaaggcgttgtgcttcaggttgatttgggaaagggaaggctctgcgtaaaataaccaaagtgttattttcaattttaaaatcaccgggcgtggcaagcatggttgtttggcgatattcattttctaacagtgcttgtttgatttgttccagattcagttgatcagataaacgtatgttttcaatacggctataaacctcggcgggtaactgccaaatttgaccatccattttattgcggatttttccgtctaaataaataccgtaaaatgcaattccacataatagagtaaaaccaagttttgcactaaaaataaacaaccgttgttttttatttttcttttttggttgagttgtatttcgtttttgtttcgcagccatttttatttagtttaagcaataaaagagagataggattttagaaaatattcaaaatcttctaagccacaaaaagcaatactttcttcatcataataatggaaatcagcttccagttcatcgtgttcttcaattgctaaattattggctttaatcataacttcatctgaatgaataaaaacagaaaattcgtttccaatgagactaaactccttttcattgcgtgattgttttgcttgttgcagataattaagtgcggtaggaatcaagtcagaatttaaccgcacttctatattgaaccaattagctattgcctcatgttccatagaaaaattaactgttacttgatcagcgttgtgagtaaattgatagtccattatttagatgctaaaagatgagccacaaccgcaagttgttgatgcatttggattgttcacaataaatcttgagccttctaaaccttcagtatagtccacagtaccaccaactaggtattgtaaactcattggatctacaaccaatttaacgcctgaattttcaacgattaaatcgccgtcattggttttttcatcgaaagtaaagccatattggaaaccactacaccccccaccggtaatataaacacgtaattttaattctgtattttcttcttctgaaattaaggttttgactttattcgccgccgcatcagtaaatgttaaaggaactgcaagatctgccataatattttccgataataaaaattgatgggttattatctaataaccaactaaaccattcaagatttataaaaaatttaatgttataatatgcgacaaattttatgtttagagaagatattatggcgattccattaagaacagaacaagaaattataaagttacgtacagcctgtaaattggcggccgatgtattggttatgattgaaccttatgttaaggcaggcattacaaccggtgagttagatcgtatttgtcatgaatatattgtgaacgaacaaaaggcgattcccgcctgtttaggctattacggctttccgaaagcaacttgtatttcattgaatgaagttgtttgtcatggtattccgactgaaggtaaagagttaaaaaatggtgatattgtaaacattgatgttacggtgattaaagacggctactacggcgataactcaaaaatgtatattgtcggtgaaaccaatatccgcagtaaaaaattagttgaggcggcacaagaggcattatatgttggtttacgagtggtgaagccgggggttcgtttaaatgaaattggtagagcagtgcaaaaatataccgagagtcaaggcttcagtgtagtgcgtgagtattgtggacatggcatcggtaccgaatttcattgtgatcctcaagtgttacattattatgctgatgatggtggtgttattttacgggagggtatggtttttactattgaacctatgattaatgcgggcaaaaaagaagtgcgtttaatgggcgacggttggacagtaaaaaccaaagatcgtagccattctgctcaatatgagcatcaacttgttgtaacgaaagatggttgtgaagtgatgacgattcgtgaggaagaagaaaaagtcggacgaattagtagaataatggttaatagataatatcaattcgaaatgcaatctttttaaggttgcatttcttttatttcaggacatgctatgttttcttatcttccaattccaaatccaacgatagcaacaataaaagcacaaaaagagcaactcaaacaatttgagttgacacattttcagcaattttctgttgatcagcttattcataatcgttcagtattttgtgatcaattattaattcatttatggcaattttttcaatttgagcaaaatcatttagcccttattgctgtaggcggttatggacgagaagaactttttcctttatcggatcttgatgttttgttgttagttgaacatgaacctactatcgagctggaagaaaaaattgcacatttttttcagtttctatgggattgtggatttgaggtcggacattcagtacgcactttagggcaatgtgaacaaagtggacgagaagacatcaccattgcgaccaacttattagaaagccgatatttatgtgggcaacaagatttattcgaaaaattaaccgcacttttgcaacaaaaaaatttttggcgaaatgaggatttttttaatgctaaagttgcagaaaaagttacacgctatcagcgttaccataataccggttataaccttgaacctgatttaaagtatagtccaggaggattgcgtgatttacatcttatttattggttggctttaaagcatataggtgctaaaaatttagaagatattttgcacgctggttttatttatccacaagaatattctttattaaagcaaagtcagcaatttttatttcaagtgcggtttgctttacatttaattttaaaacgttatgacaatcgcctgttatttgatcgtcagcttaaagtttgtgaattattaggttttgttggtgagggcaatcaaaaggttgagaaaatgatgaaagtcttttttcaagcttcacaatctatttctgtattaagtgatattttggttaaacattaccaagagcattttttagccggttcacaaattattgagcaacaagttttagattccgatttttatcttatcaataatgcaatttgtgtaaaaaatcctgatatatttattcaaatgccggataaaatattgatgctattttactatttgacacaacactctcatgttgaaattcattctgcaacattacgcaagttgtatattgttactcaacaatttactgggaatttatctgattttcctcttgcaagagaacgttttttacgtttattttcacaacctaattctatttctcgtgctttgttaccgatgcataaatacggtgtattgaacatttatttaccacaatggaaagggattaacggattgatgcagtttgatttatttcattcttatactgttgatgaacatactttgcgagtgatgttaaaattagaagagtttttagcggaagaggcgaaaaaaaattatccgatctgccacaccattttctcatcattaactgaccgcactttattatatcttgccgctttatttcatgatattgcaaaaggcagaggaggggatcatgctgaattaggtgcagttgatatgcgtatttttgcacaacaacatggctttgatagtcgagaaagtgaaactatggcatggcttgtacagcgacatttgcttatgtctgttactgcacagcgtcgagatattcatgatcctgaggttattctcaattttgctgaagaagtacaaaataaagtgcggttagattatttaacttgtttgactgtggctgatatttgtgcaacgaatgaaactttatggaatagttggaaaagatccttatttacgactttataccaatacagcctagatcagtttcaacaaggaatagatattttattaaatcatcaagaaaaagctgaagaaaaccgcaaacaagcgtgtattttattacaacaaaagtatggatttttatctgaagctcaaattgagcagcactggcaagattttccttgtgagtatttttggcgtaatagcccgaagcaaattgcttggcattctgagttgttacttgataataatcaagatttattgattaaagtcagtaatcgtttttcttatgcagggacagaaatttttatttattgccaagatcaagcgaatttattttataaagttgccagcattattggagcaaagaaattgagtattcatggagcacaaattatcacaggaaaaaatggctatgtattcgatagtttgattgttaccgagttggatgggggcttgctgaacaatgatcgtcgccgtcaattggaaggtgcattaattaaaggattaaaaacaaacaagattgttaacccagttcgtataaataaccataaattacaacatttccatgttaaaacagaagtcagatttttaaatgttcataagcaagaacaaactgaaatggagctttgtgctttagatagagcaggtttattagcagaaattagtcaaatatttgtacaattggagttgaacttattaaatgcaaaaatttctacaattggtgaaaaagtagaggattttttcattttaaccaataagaaaaatgtagctttaacggaacaagaaaggttacgtttacaagatcgtattgaaagtaattttagctaaagataaatgtctacattgcatagattttttatgctaaaatccgcaaccgatttattttattgctgaataggaaaaagaatgaaggttttagaaggtatagttacagcacctaatgccaaaattgctgttgttattgcacggtttaatagttttattaatgaaagtttattagagggagcattggacgctctaaaacgtattggtcaagttaaagatgaaaatattactttagttcgtgtaccaggagcttatgaattgcctttaattgctcgtcgtttagccgatagtaaaaaatatgatgccattgtagcgttgggtactgttattcgtggcggtacagcacattttgaatatgtagcaggtgaagcaagcagtggtttagggcaggttgcaatgcaagcggaaattccggttgcatttggagtattgactacagaaaatattgaacaagccattgaacgagcgggaactaaagcaggtaataaaggtgcggaagctgcattagttgcattagagatggtgaatttattagctcaaattgacaaggcatagtagataaaatgacagaaaaagtaaaaaaactatccccacgtcgtcgagcaagggaatgtgcggtacagaatttgtattcttgggctatttcaaaaaatgcacctgaagaaatagaattaaatttcattgtggatcaagataatgaaatgaagggcgtagatatgccatatttcagaaaattgtttcgtcaaacagttgaccatgttgaaattgttgatagcataatggcaccttatttagatcgtaataattttgagttagatcctattgaatgtgcaattttgcgtttagctgtttatgaattgaaatttgagttagatgtgccttataaagtggtaatcaatgaagctattgaggttgctaaagtatttggtgcagaagaaagccataaatatattaatggtgttttagataaaattgcacctgcactttctcgtaaatagataggtttatcataatgagcaatggcgaatttgatattattcaacgctatttcatcggatcaaaacgtccacaacgtaaagatgtgattgtttctatcggtgatgattgtgctattactgaacattatcaaaatcagcgaattgctattacgactgatacgatggtagaaaatgtccattttctgtcttctattaatccttcggatttagcatataaagctgttgcaacaaatttaagcgatcttgctgcaatgggggcgactcccgcatggttttctcttgcaatcactttaccttatgttgatgaaaaatggctcaatgaatttagtcaaagtttatttgatgtattggatcattataatgtgtcgcttattggtggagatacagcaaaaggtcccgtatatacaataactattactgcacaaggcatcgtacctaaagggaaagcactttgtcgccacagtgcacaagatggtgactggatctatgtttccggcacattaggagacagtgcggcaggattggaattactattaaaaaatacagaggaaacgcatagtaaaagtcatcaaagtgcggttgattctgcacaagaatatttaattcaacgccatttacgtccaacccccagagttttgcttggtctggaactagctagtgctgagttggcaaatgctgcgattgatatttctgatggatttattgcagatttaggacatattttacagcgtagtcaatgcggtgcagtgatcgatttagataaattacctttatctgagcaattaatcaaaactgttggtatagagcgagcggagcgatttgctttaactggcggagaagattatgagttgtgctttacagttcctgatcgcaatcttgaaaagttagagcgagctttaacccatattggtgtgaattatagctgtgttggacaaattcgtaataaaaaacgtatcacttttcaacgcagcggtaaaaccgttgagattggttcattactcggctttgatcattttaaataagatttcattatgacaaataatcctttatctcgtatttctttaaccaatcctattcatttttttgcacttggcttaggttcagggcttattcatcctgctcccggcacttggggtacccttgccggattaattgttggttgtttgctattacagataatgtcggtgttttcttttgcaattttcactgcactttgttttttattaggatgttatttgtgtcaacaaacagcggatgatatgggcgtacatgatcatggctcaattgtgtgggatgagttcgtcggtatttttaccgtgttactctctattcctgaattatcattgatatggtgtagtattgctttcgttgtattccgtatttttgatattttaaagccttatcctattcgttattttgatcacaggttagaaagtggcttcggtattatgttagatgatgttttagctgctatttatacggtcataagcatttctatcttaaatgatcttgtatagaggcgattgattatgctgaatttattattggttaatttattcgggttacttaccccgggacctgattttttttacataagtcgtttagcagctagtcattctaagagaaatgccatttgtgctgcgtttggtattagcttgggttgtttagtttggtcaacttcagcaattcttggactggctgttttattgacaacttacccaagtttgcaaggtatcattatgatgctaggtggcggatatttggcttaccttggtgtattaatggtgaaaagtcataacaatattgtctttgataatcgtgaacaagcagaaaatttaagaaacagtatgggtaaagaaatcttaaaaggattattgattaatttatctaatgcaaaggctattatcttctttagtagcgtgatgtcttttgtattggttgatttaactgaaacatggcagattattaccgcacttattttattaactcttgaagtatttttgtatttttcttttattgcacttattttttctcgtaaaaccgtaaaaaaattttatagccaatatagccattatattgataactttgcagggatcttttttctttgttttggcggttatttaatttatagtggtcttttcttaggatttggcaattgataaatagagagggataaaatgacgttaaaaattggtattgttggttcgggtggtcgtatggggcgtcaactgatacaggcagtatatcatactgaaggcgtagaacttggtgcggcatttgagcgtgttggttcatctttagttggaactgatgcgggagaactggctggaataggtaggattggtattaaagtaaccgataatttaactcaagaaaaaggtaactttgacatcttaattgattttactcgagcggaaggtaccattcagcatttagcattttgtgtagagcaacataaaaatatagttatcggtacaacagggtttgatgatcaatccaaacaagctattcaacaagcagcacagaatattgcaattgtttttgcctctaattatagtgtgggcgttaatttagtttttaagctgttagagaaagcggctaaggtcatgggcgattattgcgatattgagattattgaagctcatcatcgtcataaagtagatgcaccttccggtactgcactatctatgggggaacatattgccaaaacgttaggcagagatttaaaaacgcatggcgtgttttctcgggaaggtattacaggtgaacgtaagccggatgaaattgggttttcaacaattcgtgcggcggatgttgttggtgagcatacagtatggtttgcggatatcggtgaacgagtagaaatatctcataaagcctccagtcgaatgacttttgctaatggtgctgtaagagctgcaaaatggctttctactaagcaagaggggctttttgatatgacagatgtactggatttaaataatctgtaagtgcggttagatttggttcttgaaaattgcacatctttgatctttcagtatttgtcatttaagatgttgctaagatgttgatggaataaaatcaatgccaaaattttagccagtccgaaaaatgggtataatgcccactgatattatatattttaggaatagtagtatgaaatttatttcatttaatattaatgggttaagagcaagacctcatcaacttgacaggattgtagagaaatatcagcctgatgttattgggttacaggaaattaaagtgtctgatgaagactttccctatcatcttgttgaacatttaggctaccatatttatcatcatgggcaaaaagggcattatggtgttgctttgttattgaaacaagaacctaaagtaattcgtagaggcttttctactgacgatgaaaatgcacaaaagcgtataattatggcggatttagaaacagattttgggttgctaacagtaattaatggttattttccgcaaggtgaaaaccgccagcatgaaacaaagttcccagccaaagaaaaattttatgcggatctgcaacattatgtagagcaagagcatgacagaaataatccaattttaattatgggggatatgaatatcagcccgacagatttagatattggtattggtgaagaaaatcgaaaacgttggttgcgtacaggaaaatgctcatttttaccggaagaaagagaatggataaatcgtctatataattatggactgattgatacatttcgtcataaaaatccgacaatcaatgatcaattttcatggtttgattaccgctcaaaaggctttgatgataatagagggttacgaattgatcatattttagtgaatcaattattattagaacgttgcgttgatgccggtatagcttttgatattagagcgatggaaaaaccatctgatcatgctccgatttgggcggaatttaagtgaggaacatagaatgggaattgaacaagaatggcaaaattatcgatctaaaattaatgataaattagccgtattttcagttaatttaaaacttcttgaacaatttccagtcgtaaatcatatatgtgaaattgttgtccattttgaagtcccttatatttcagatgcacaaggcttaccgcaaatagaaagttacgccggtttgcaacaagatttgctcaaaatatccagtttaatttctgcccaacctaatgtttattacgcaggcaatattctttgtaatggcaatgctacattgtatttctattgtaacgatgctttagatattacagatgtattatctgataattttccaaacgctgtaaatattgagaaacaattcgattcaacgtgggatctatattttgattttttgatggcatctcaggcagatttgaaagtaaatgcagcagaagaattattggcaactttaattgaaaaaggagaagatatctcgaaaagttatcaaattgagcatactttttacttttacaaagaaaatgatctttacttatttttggagaatattgctacttctgacatatcatttttatcgctaaaacattcttctaagcaaataagtgtgaatggatataatgtatatattgctaaaatagagcaagaattatatttaaatgatgccagtatctatgaatatataagaaattttgaagaactcgctttgcaacattcaggtgaatatattggttgggagagcgaagatattggtataaataaaaatcaactaaattaatttttaaatttaaaaaaccttacaacagaataagatgtaaggtttttaatcggattaaagcaccttgacaatactttcacataaataacgaatattatcttcagttacaccggctaaattaatacgtcctgaacgcacagcataaatggcaaattcttcttttaagcgatccacctgttctgcatttagaccactaaaagagaacatgccattttgttcaataatgaagctaaagtcttgcttggcaccatattcttttaataattcaacgaattgataacgcatatgtttaatgcgattacgcatttcggttaattcggattcccattgttgacgcaataggttatcacctaaaataatagaaacagctgtagcaccatgagaagcagggttagagtagagagtacgaataattgatttcacttgtgttaatgctattgctgaaatttcttctgtttctgctactaaagtaaacgcaccaacacgttcattgtataaaccaaagtttttggaataagaacttgcgactaataattctttatgattttctgcaaaagttcgcaaaccaacagcatcttcttctaacccgttagcaagaccttgataagcaaaatcaaagagcggtaaccaaccatttttttctgacatttctgctagtattttccattgctcaggggttggatcaatacccgttgggttatgacaacaaccatgtaacaacaccacatcaccttcactggcattgcttaagtcagcaattaaattatcccaatctaaagcttttttctctgcatcgtagtaacgatattcacggattgtcatacctacagcgttgaaaatagcattatggtttggccaagttggtgaactaatccaaacgttttgagatgtggtttgacgtttgataaattcggcagcaatacgtaacgcaccagttcctcctaaactttgtactgttttagcacgtccttgtttaataattttagaatttgtaccaaataataattctttagtgtatgaattaaattctgcaataccatcaatagttaaatagtttttagtggtttctaattcaaatagacgattttcagcttctttaacagctttcataatgggggtgttaccattagcatctttatagaccccaatacccaagttaattttattggcacgcgtttcagatttaaaagcctcacctaaacctaaaattggatcagcgggtgccgcattaatattctcgaacatagtagtatcctcaataaatagttgtgtttgaatagatttctttatacttgtaaaaacttatctttgcaaccctttagctaagttaaatttaattatttaattttaactttataaaatatattaaaaattatttgctagattaaattatttcaatttttccaatgtccaatctaaaccaaattgataatcttgcggtagtatgtagcgtaatttttgtaaattatctattaaaatagacggagttggatgagataaattaagatgcccaactttacgaccttctcgtatttcttttccataccaatgtaattgtgaaaatggcaaatttaaccattgtggattatgttcagtgccaattaaattcaccataaccgacggcatagccacttgtaaatcaggcgtaggtaaatctaataacgcacgaagatgtaattcaaattggctaatcgaacaacctaattgcgtccaatgtccgctattatgtactcttggtgccaattcattgactaataattgatcttgcacaacaaaacattccattgccattacgccaacataatctaatttatccataattttagccaacattatttcggcttgtttttgttgttgtgactgttgtggaaaatttaaattcatgacactgtaacgtaaaataccattctgttgcagattatgcgtaacaggataaaaacgagttttgccatttttaaaccttgcaccaaccaaagaaatttcataatcaaaaggaataaatttttcggcaataacttcgccaaaaagctcattgccgattacatcttgattgtttttatctacaatccattgtcctcgtccgtcgtaacctcccatgcgacgttttacaacaactttttcaccaatttctgtaaaaatagtgaaaaaatcctccgcactttgtaccaacctccaaggggaagtaggaatatttagtgcgttaagcaaggttttttgtgtaaaacgatctgctgtagtggcaaaaattttttgattaataaatttatcgtgattagccaacatttctgtaaggggtgttttttcccaacgctcaatttctgctgtaataatactgttagcaggcaaatcaaaaacaggtgcatcaaaagcaagaggttggacattaatatctaaaggtgcaccggcataacgcaacattctgcccaattgcccattgcccaaaacatacactgtgggatataaagtgcggtttaccattaaatgatccttatacttaattaagatattgtaaatttttatttactctgattttacttgatgaggttttagtagtaactcatcttcgttcaatttaaataatttggctattgtatcacgataggatatttctaaagtttctcggctggttgccgttacaccttgatcaattaagaaaccgtcgttaacatcataaatccagccatgcaaagaaagtttttttccacttttccaagctgatttaacaatagatgagctgcctaagttatacacttgttccgcaacattaattcttgtcaacatatcagcgcgtttttcaggagataacttacccaataaatgaccatgtttaaaccaaatatcacgaatatgtaacaaccagttattaatcaatcccaaatcttgatccaccatagcggctttaatcccaccgcagttggtatgtccgcaaataataatgtgctcaatattcagtacatcgacagcatattgcaccacagataaacaatttaaatcagtatgaataacttgatttgctacattcctatgcacaaataattcaccgggttttaaatttgtcaaattttcagcaggaacacgactatcggaacaaccaatccataaatagctaggtgtttgattttctgctaacgctttaaaatactcagcattttcttctttcatcctatttgcccaactaaaattattggcaaataactgttcaatttttttcatttttttaccgctcctaaagatgcacagtatagcctagaatagaaaaacggtaaaataaaaagccctgtaagataacagggcggcgaaatttaggtaggattgaatatcatcacaacaatgtcgcttgtttcattttctgcacgaattctgccaattcggagaggcatttttcttgatctgtgagattttgttcaatgatttgcactatagctgaacccgaaattgcaccagcaacacctgattttaacgcatctttaacttgttgtggttgagctatgccaaaaccttgtaaaatcggagctgagccatatttttttaagtctttgatgagattagctagatttttcgcactttgttgattttcagcacttgttacgccggctcgagaaactaaataaatgtagcctttgcttttttccgccactgctttaagggttgtttcatctgcattgggtggacagataaaaaccggttgaatgtcatatttttgagcggattgaatatacggttcagaagcaagcagaggaatatcagccaccaataccgcatcaactccgacttcagcacagcattgataaaatccatctaaagtttgagcataaattaagttggcacaaaggagtagactgatcggaatatcgggatatttggaccgcactttggcaattagttgaaaactttcttttgtactgcagcctgcgtttaaagcacgatgattagcagcttgaataaccgaaccgtcaagtaaaggatcggagaaaggaaacccaagttccaaagcgtctgcaccgttatccactaaggtacaaataatttcaaaagagcggtcgaaatttggatcgcataaagtaacaaaaggaacaaaagcaccttgtttttgcttttgtagttgtaaaaatttttgttcaaaatatcccatcagataattcctttctcggttaaaattttatctacagtaaaaatatctttatcgcctcgacctgataaatttactacaagtaattgttctttttccggattttgtgcaatgagttttaacgcataagccaaagcatgtgagctttctaaagcaggaataatcccctcatgtttggctagggcttgaaatgcctcaagtgcctcatcgtcagtaatactttcatattgagctcgtccaatagcatgcaaatgggcatgttcaggaccaacggacggaaagtctaagccggcagaaatagaataagattcctcaatttgtccgtcttgagtttgcataatcggggatttcataccaaagtaaataccaatagatccatgacgaagcggtgctccatgctttcccgtatgaataccgttgccggcaggctcaattccaattaggcttaccgatttttccgcaataaactcagcaaacataccaattgcgtttgaacctccgcctactgcggcaataacggcatcaggtaagcgattttccttagctaaaatttgacgtttagtctcttcaccaatcattttttgaaattcccgcacaatggtcgggaatgggtgaggtcctgctgctgtacctaataaataatgggttgtttcataattagctgaccaatcacgcatagcctcacagcaagcatcttttaatgagcaagagcctttttcaacaggaatcacctctgctcccattaaacgcatacgaaatacattcggcgattgacgctcaacatcttttgcccccatataaactcggcaaggcatatccaacatagcacaagctaaagccgttgctacaccgtgttgtcccgcaccggtctccgcaataatacgtgtttttcccatacgttttgccagcaaaatttgccctaatacttgattagttttatgtgcacctccgtgaagtaaatcttcacgttttaaatacaattttgtttttgtacctttagtgagattgcgacataaagttaatgctgttggacgacctgcataatttttaagcaaatcttgaaattcttgttgaaatacaggatcgtgccgtgcttcaacaaacgctttttctaattgttttagtaccggtaccagaatttccggtacatacattccaccaaattcgccaaaatagggatttaaaattgtatccgtcatattttttccttattgattttggattttgccaaaaactgtttgtaattttatttgatcttttatgccgttggcacattcaacacctgaatttaaatcaatccctagacagtgttgctgcaatgcttgttcaatattttgaatatttattccaccggcaagcatgactttatatttaatggagggaggaatacaattccagttaaaagtttgtcctgtgccgccttgtcggttatctgctttactatcaaaaacatagcgatctacataaggaatttcttcaaaatctaccgcacttttcccttgttcatattgctcggtaacgttaatcgtaactgctttccaaatttgacattgtgtaggtagaacttggcgaagtgcggtaataaattcagcattttcatcaccatgtaactgcacggcgaacaattgtaattgtgtagcaatgttatggataaacgcaatagactgattttggaaaacgccaacaaaaagcaaaggtgcttgcttaaccaatttctgtgcttgacatagggagagtttacgaggagaaccttcagcaaaaatcaatccgccgtataaagcaccttgagcatagcttgctttgacatcttgtcctcgtgttaaaccacaaactttgtgttcacccaaaagtaccgaacgtacggcattgttaagatctttaccactagttaaactgctaccgattaaaaagccatgtacataaggttttaattgttgtacttgttgatgagaagaaatacctgactcgctgatcacaatgcgatctgccggaatttgtcttgccaaaggaggcgtgcggttaagatctacggagagatcgtgtaaatttcgattattaattccaattacttttgcacccagttttatggctcgttctaattccttttggttggatgtctcagttaaaacgcccattccaaggttatgtgcaagatcagataaagtgcggtaagtttcatcatcaagtatcgacaacatcaataaaattccatcagcttgataataacgtgctaaatacacttgatatttactcagtataaaatctttgcaaagaataggttgagtagcctgcttacgtactaaaggcaagtagttaaaatcgccttggaagtatttttcatccgttaaaacagaaattaccgaagcataatttttatagacatttgcaatttctactatattaaaattagaacgaattaaacctttcgaaggtgatgcttttttgcactctaaaatgaaagcggggcgttgatgtgtaccttggcttaacgcttgataaaaagagcggtcggatttttttattttctgttgaaattgtgcgagaggaaacgacgattgtttttctgcgatccattgttttttatcttgtacaattttttgcaaaatagaagggatattgtgttgcatgataattcctatttattgatacgtttttaattggtttaatgtttcaaatgcttcaccgttcgccataatatttaaggctttttctgcattggctttaagatcatcattgccaaataatttcattaataaggcaacattcatagcaacagcttgattatgctcatctttgccttttccttgtaaaagtgcggtcaatatttcggcattttcttctgccgtaccgccacgtaaggtttctaatggtttaggagtaaaaccaaagtcatgaggtgttaaactataatattcaatttttccatgacaaatttccgcaacatcggtttttccatgaatagcaacttcatctaaaccggaaccatgaataacaatactatgctgatgccctagtcttaatgcactttcagcatagattttaagtaagtgcggtgtataaacccccagtagttgatgttttgggcgagcgggattgcataaaggacctaaaatattgaaaatcgtgcgtgtttttaatatttgtcgtacaggtgcgacatgtttaaatcccagatgatattgttgtgcccagagaaaacaaagattgagattatctagggcttgtttggacttttcagcagataagtcaatttttatccctaaagcatttaatacatcacttgcaccgcttttgctggatacacttcgattaccatgttttgccactttgtatcctaatgttgcagcaacaattgccgcagtagttgaaatattgatggtattagcattatcacctcccgttccgacaatatcggcaaaagggtagtctatgaatggaaatggcttagcgttggcaataatggcttttactgcaccgctaatttcatctgcttgttcaccacgaaattttaaagcgataagtacgcctgcaagttgttcattagaaagttgtccttgaataatataatgaaataactgttgtatttgttcttggtttaaatgttgtccgtcgaaaagttgactgattaattgttctgtttgcatgttattttccttcttatttttcgttctattttgacgtcggtaaattataaatcatcatattgttctctacttttagccaatagccattgaatactttgctctaataactgtgagccttgcttcgttaatatactttcagggtgaaattgaaaactgcaaataggcaaggttttatggcggatagccataatgatgcccttatattcagcattaataataaactcttccgaaatttttcttcccattaaagaatgataacgagcaactgacataggattatctaaaccctgaaacatcatttggttatcatgataaatatttgatactttcccatgtgaaatttcaccggagggaacaacttctccaccgaatgcttcaatcaaagcctgatgccccaaacaaatgccaatcatagctactttaccttttagtgtttgaattaaaggcaataaaattcccgcctgtgcaggagtacctggccctggtgagagggctaaaacagtctctttttctgctaaaataatttgagttaataactttaaatcgaagttattgcaaaaaacttgtacttgatgccctaaactgcggaattgatctactagattgtaagtaaaggaatcaaagttatctaaaaatataattcttgccatattgtctccttagtcttgagtattggtttgcaatattgcattaatcacagctttagctttgtgacgggtttcatcagcctccatttgtggatcggaatctaagacttcaccacaacctgcttgaatataagcaataccttgttgtacaaaagcggaacgtatcacaatacaggtatcaaaattaccatcagaagataaatatcctattgcaccgccataactatgacgcttttgtttttcaacttggtaaattaattgcattgctttaattttcggggcaccagttaaagtccccatattcatacaagcctgataagcatgaaaggcatcaagctcggggcgtaattttccgactacacgagaaacaaggtgcataatatgagaatagcgatctacttgcattagctccttaacctgtcttgtaccgctttcacagactcgagcaatatcgttacgagcaagatcaacgagcataagatgttctgcgagttctttcttgtctaaacgcaattccaactccaaacgagtatctaattcaggatcgacattaccctgttgatcaaagccacgagaacgagatccagcaatcggataaatttctacttggcgattttcagcattatatttcaatgcactttcaggagaggaaccaaataagatgaaatcggtatcttgcataaaaaacatataaggacttgggttattgttctttaattgacggtagctggccaacgtatttgggcattccagcataaagcgacgagaaggaacaatttggaaaatatttcctgcataaatatgctgttttaattgttcaataatggttttaaaagattcgtcttctaaatttacttgtactgcaacactcgcttttgagacagctaagtgcggttcaattttcgttaatttttgacaaatttccatcgcacttttttgcacattacctaattcttgcgaatgaaaacagaatgattgtagagtagtttgttgtaattgatgatcaatcaccaataaattttctgccaaataaaatacatagtcaggacaggttaatccatcatcttctaggctaatattttccattggtataaaattaattactaaatcataggcaaataatccccctagaaaaatgggtattttggattgagcataaatatctgttaaacaacgtaacccatcaaaaacggttgttgcctgtaatttgctatcttcatcgagattgggattaatcggagggataataacttctaaatcgctttcagacttcacaagtatttttgctgttggctgtaatttttctttaataagaggtaaaactgtttttccattgctggttaaagcgttaaatataatagtattaccgaaacaagatattttgattgcggaatttacaaacaataggctttttaaactatttttactggagatttccgcactttctaacaacaaagtattagttttttgttgacaaagtgttgcaaaaactgcggtaggatctttgtgataaggtaacttctgagttaatacttcaataaagggggtaaacataaaagaatccttatttagaataaatttaaatatgaactattaaactagtacagatttgttttgtcaatagtgaagtaacattattttaaaagtaagtatttgaaataaaaaaattgcaattttcttgcgagaaagcataagcaataaaattgcacttttaaataaattcgttatgataatcggttcataatttcacttatataaggaagaaaaaatgtggtctgagttattgattggttatggcttgtttatcttagaaatactcacaattttattaattgttgcagggatagtgatgatgattatgacactgaaagaacgtaaatcacatcaagtcggagagttggttattacagatttatcacgagaatatgaaaataacagtaaaaaattgcgtgatttttacctgagtgacgatgcgttaaaacaacgtgaaaaagagcagaaaaaagccgataaacttaaagcaaaagaagaaaaagcccaacgtaaaaaaggggaaacgttagcagaaaaaagaaaaccacacctttttgtattgcattttaaaggtgatatttctgcttcagaaaccaccgcacttcgagaagaaattagtgcgattattgcggttgcaaaagaagatgacgaggttttattacgcttagaaagtcccggtggagttgtgcatggctatggattggctgcttctcaattagctcgtttaaaacaacgcaatattaagctaactgtagcagtggacaaagttgctgcaagcggagggtatatgatggcttgtgttgcagataaaattatttccgctccttttgccatcattggatctattggtgttgttgctcaaattcccaatattcatcgcttattaaaaaaacatgatatagacgttgatgtaatgactgctggtgaatataaacgcacaatgaccattttgggtgaaaatacagaaaaaggaaaagaaaaatttcaacaagatctagaagacactcatttattgtttaaacaattcgttacacaaaacagaccgcacttggatattgataaaattgcaacaggtgaacattggttcggcaaacaagcattagcgttacatttagttgatgaaattgcgacgagtgatgatttattgttacaagcaatcaaagataaaacagtgctttcggtaaaatatatgatgaaaaaatcactcattcaaaaattaggcaaacaagcagaagaaagtgctaataatgtgttgttacgattgctgaaacgtgatgagagtactttgatataagcttactcaacattgcccaaaaagagattaaaatttggtttacatttttgttgtttgatattaatatctcaagcagtgctgacgtgatttaatgcgacaatatttttgtaaagatagaaaattaaatcgtaagctattcaaaaaatttgaagaaatttatatacataaaattaaggtaaaataatgaaactatcacgttttgtattatctgctgttgtagcagcaacattgtcggcttgtggtaatttaagtaatgtcaccgaagagggtacatcagataacttgaagtggcctaaaattgatcagtcaagatttaaccatgatggtagccaatttggatcgtggccaaactgggataacctacgtatggttgaacgtggaatgaataaagatcaactgtataacctattgggacgtccgcatttttcggaaggtttatatggtgttcgtgagtgggactatgcttttaattatcgtgagaatggcgagcataaaatttgccaatacaaaattttattcgataaaaatatgaatgcccaaaatttctattggtttccaaatggttgtaacggttatgcatcttttagtttaaatacggatctcttatttgattttgatcaagatacgttgacctcaaaaggtgaagaagctgttgataatgttgcaatgcaattagaagcgttttcagctaaagaaattaaaattgttggttttactgatcgattgggtacagattcttataacttggatctttctcaacgccgagctgatcgtgttaaagagcgtttaattgaaaaagggttaaatattgatattatcgctattggatatggtgaaacgcaacagattaaggcttgcaatgatgtgccagctaaagaactaaaagattgcttacgtccaaaccgtcgtgttgaaatttcagcatacggaaacatctcaaaaaaatatggtaatggtgagctgaaggggggtacaactggtccatcattatactacgaaaaataatctctcttgatataggtaagggcatcaaacgatgccctttatttatagaattatttatcacttttgtgcaaaatttgattaatcaatttctgagtgagagaaacataactttgctttttattataatagcgatagctgaaattgagcagataatagagctgataaataagttttctttctaagtaaccttcttccagtggatatatttcattatagcgttgataaaaattagttgggaaaggctcaaaaagtgatgaaaaagcaatatcgcattctctatctccccaatagcaagcaggattgcagacaaaaattttatcatctacttgaatacagttttcaatccataaattgccatgcagtatagagggttttgggttatgtttgctcaaagtatctgcaacaatttgcacaataagatctatatttccaaatatcaaacctttttctttacatatttgcaattgccagccaatacgattttcgctgaaaaatttagcccaacttgtctgccaatcatttggttgataaataggacctaaccaagtatcaaaatctaatccatatttatctggtccttgtatttgatgtagctgtgctattttttcagcgaatattgtaaatgaagactgtttattctttgacttatttaacgcttctaacagcaaaaaactatgcccttgtgaattgccaattccataaactaaagggacattaattgaattagttttagctaaaagagctaactggtctgcttctgcacgaaacatagagcggtaggatctttcgtttattttaacaaaaacagtttgaacctcatcattaatcagccaaatttcattcatttcacctgaatataatttttctttatgtttaataaaatagtaggcaccaaattgttctgccagtacctgagaaatagatttccacatagctcctccgatatgattcaagttagcctgactagatgataatctgaataccggtaatattctgtgataaatatcaagttttaataaatatcttattaagtagtgaatttatgtaactcttatctatttatatctttactcatatgttatgtggattgaatatttcagcgaaatgataaggatataccaattagtctagttgttactaatacagtaaaatagatacgttttctaagagttttctgttaaaatgcaccgcacttttattgtacaaggtaggtataaataaaagtgcggtgctttcagcacttttttattttatgtttaactcaatttacaagtaacctttcgtatgggctaccactgtataaggattcacaatgccaattattactttacctgacggttcacaacgtcaattcgataatcccgtttctgtattggaagttgctcaatcaatcggttccggactcgctaaggctactattgccggtcgtgtgaacggcgagcgtcgagatgcctcagatatgattagtgaggatgccaatcttgaaattattactgcaaaagatgaagacggtttagagattatccgacactcaacggcacatttattagggcatgctatcaagcaacttttcccaaatgtgaagatggctatcggtccaactattgacaatggtttttattacgacattgatttggaccgctctttaacccaagaagatattgataccctagaaaaacgtatgctggagctggcaaaaacgaattatgacgtgataaaaaaacgtgtcagttggcaagaagcaagagatacttttgaaagtcgtgctgagccttacaaaatagctatcttagatgaaaatattgcaaaagacgaccaacctgcactttatcatcacgaagaatatattgatatgtgtcgtggtccgcacgtacccaatatgcgtttctgtcaccattttaaattaatgaaagtagccggtgcatattggcgtggaaatagtgataataaaatgctccaacgcatttatggtacggcttgggcagataaaaaacaattagccgattatttacatcgattagaagaagctgcaaaacgtgatcatcgtaaaatcggtaaggcgttggatttataccatatgcaagaggaagcacccggtatggtattttggcataatgacggttggacaatcttccgtgagctggaaacatttgtgcgtacaaagttaaaagaatacgattatcaagaagtaaaaggtccatttatgatggatcgtgtgctttgggaacgtacaggacactggcaaaattatgctgatttaatgtttactacacaatctgaaaatagagaatatgccattaagccaatgaattgtcctggacatgttcaaattttcaatcaaggcttgaaatcttatcgtgatttacctattcgtatggctgaatttggttcttgccatcgtaatgaaccatcaggatctttacatggattaatgcgtgtgcgtggttttacacaggatgatgcacatattttctgtaccgaagatcaaattgaatcggaagtaacgagctgtattaaaatggtttatgacatttatagtacgtttggctttaccgatatttttgtcaaactttctactcgtcctgaaaaacgcattggtgaagatgtcatgtgggatcgtgcagagcaaggcttggcaaatgcacttaaacacaatggtcttgaatatgaaattcaagagggggaaggggcattttatggaccgaaaattgaatttgcattaagagattgtttagatcgtgaatggcaatgcggtacaatccaattagattttgcgttacccggacgtctagatgctacctatgttgcagaagataatgcccgtcgtacacctgtcatgatacatcgtgctatcttaggttcaattgaacgttttatcggtattatcactgaagaatatgcaggttttttcccagcgtggttagcaccgattcaagctgttgtgatgaatattactgatagtcaagcggattatgtgcaaaaagtagttaagcaattttctgaagcgggattacgtgtaaaagcggatatacgcaatgaaaaagtcggtttcaaaattcgtgaacataccttacgtcgagtaccttatatgctagtttgcggcgataaagaaattgtggaaaacaagattgcagttcgtacccgtaaagggacggatttaggcacgtttagtgttgaagaatttgttgagattttaaaacaacaagtgagaaaacgtgagttaaccttgttaggtgaataatgataaaaaatataatcggcacttaaaggtgccgattttttatggaattgttcacttaatacagtaatgaatacaacaaacgacgaaatttatttgtaatcggatcgttattaccaatggcagctaaaatcgctaaaaattgttgcttagcctctccatttaacgcattaagatcttgttttaatatatcaaacagcaaatttaatgaagcctcattacgattggcttgatgcaattgtaatgctagttttaatgcaatttctgctgttggatttttagcaaaatcagcttgcaattgctgaatttcaggggtatcagtcgcttttattaaaagctcaatttgagcaactaaaccatgccagcgactatcacgatcttgtagcggaattttatctaaaatctcttgggcgggttcaatgcgttttatcgtaatataggtttcagcgtagagtagagcaatatcgctatttttcttatcagataattcccatgcttctttgagcaacggtagagcgtcattatattgttcttgttccaacaaatttaatgcctgattgaatttcatttcttcttccttcggtaaaattagagataaacgttgttgtaacataatttcatctaaagaaccttggaaagcatctaatacttgtgcttgattaaataaataagttgttggtaatgattgaatatgaaattgtgcagcaatcattttttctgtttcacaattcactttacctaataaaaattgtccttgatatttttctgcataacgagtcaaaagtgcggtaaattctaaagagattttgttacttggggtataaaaaattaaaacaagaggtgtttgtacagaactttgtaatacacttgttagattttgctcattaatatcaataatatatgacataaaatttcctacgtttatttaaaggtaaagtgggtaaattgtaacaaaccaatcatttttttggaaaatatttcttcgatttaagattttcttaatattttttaataatacaaaacagctgataaagaattcggtcaggatgctaaaatagatgtaacagaagtgcagaaattaataaaaaccttggtattgtttgatatgagactgatttaaaacgtcattataaattctccaaaatttaatcgctaaaatagaagatctttgctagaatccgtacgaaaaacacctttctaatgtttttcatttttgttattaattcatttggaaacacatataatggaaaatcaatcttttctacaaaaatacttcaagtttaacgaaaaaaagacgactacaaaaacagaaatcattgcgggaatcaccacattttttactatggtttatatcgtttttgtcaatccgtcgattttaggtgatgcaggaatggataaacaggttgtcttcgtaacgacttgtttaattgccggtttgggaacaattgcaatgggattatttagtaatttacctattgcacttgcaccagcgatgggattgaatgccttttttgcttacgtcgtggtaggaaaactagggtattcttgggaaattggtatggggacaattttctggggatcggtagggttacttttactaactgtctttcaaattcgctattggctaatggcatctattccgcttagtttgcgtgttggtattggtgccggaataggattttttattgctttaattggctttaaaaatatgggattggttgtacctaatccggtaacgttggtttcgcttggcgacttacacaattcgcaagtattaatgggcgttttgggattttttattattgtagtgttggctgcacgtaatatttattccggagtattagtttctattgttactattacggctttagcattgatttttgatgaaaatgtggtttttaacggcgttatttctatgcccccaagccttgatgctgtagtcggaaaagttgatgttttaggtgcattagataccgcacttttaggcattattttttctttcttattggtgaatttatttgattcatcaggaactttgcttggcgtaacggacaaagccggttttagtgatgcacaaggtcgttttcctaaaatgaagcaagcgttatatgtagatagtattagtgcggtaacgggttcttatatcggtacatcggcaatcagtacttatattgaaagtggtgctggagtttctgtcggcggtcgcacaggaatgaccgcagttgtagttggaattttatttttacttactattttcttctctccattggctggtatggtgccggcttatgcaacagcaggtgcattagtttatgtcggtattttaatggcatccagcttaattcgggttgaatgggatgatttaacggaagcaactccagcctttattactgcggcaatgatgccatttacttattcaattactgaaggtattgcgtttggttttatcagctattgtgtcatgaagacttgtaccggtcgttggaaagaaattaatgcaccggtttgggttgtatctttgctctttgttgctaaatttatttgggttggataaatccttaattattgaatagatctttttaaagcggacattagtccgctttcttgttgatttaactagaattccgggatttttatggaacataaattggaagatattatcgctatttttaatcaatgctttgagcaagaatataatacaaaattagttaaaggtggcgatgagccgctttatgttcctgccaataaagattgctcttataatgctatttatttcgcacgtggtttttatagtagtgctttacatgagattgcacactggcttgttgcgggaaaagagcggcgtaaattagaggattttggttattggtatgagcctgatgggcgttcaatggaaagacaacgtgaatttgaacgagtagaggtaaaaccccaagcattggaatggattttagcaactgcggctggatttcgttattttgcgagtagcgataatttaaacggtaatccgggagatacacaaccttttaaattagctgtttatgagcaagttaaaacttatgcacaaaaggggttaccgaaacgagcagaaactttgcgtaaagccttagcggaattttataaaacagaagaccgcattgatctaagtaaatttgacgtagcgaggatataaatgttagctctggaaattaaacaattgacaaaagaatataaaaatggggttaaagctttatccggtatcgatcttaaggtagaagagggcgatttttatgcgttgttgggacataacggtgcaggaaaatcaacaaccattggtatcatcagctctttaataaataaaaccagcggaacaataaaagtgtttggttatgatttggatcggcaattagctcaattaaaacggcatattggcttagtaccacaagaatttaactttaatcaatttgaaaaaattcaagacattctagtgaatcaagccggctattatggtattgagcgaaaagaagcacttaatagatctgaaatatggctaaaaaaattagatttatgggaaaagaaagatcaacaagctatgcgtttatcaggtggtatgaaacgtcgcttgatgattgctcgagcattaatgcacaatcctaaactattaattttagatgagcctaccgccggtgttgatattgaactgcgacgtgctatgtggacttttttaaaagaacttaatcaacaaggaacaacgattattttaaccacacattacttagaggaagctgaaaatttatgccgtcatattggcattattcagcaaggtaaactgattgttgatatgtcgataaaagccttattgtcacagttagagacagaaacctttattttagatttagcactttctagttcaacgccaaaggttgataattacaacgtcacaattattgatgagctaacaatggaagttgaagttaagcgtggacaaggactgaataatttatttattcaattaaatggtcaaggaattaatgtattgagtatgcggaataaagccaatcgcttagaggagctgttcatttctatggcgttaaataaaccaaaaatcacggagaaaatataatgttagcttggattgcgtttaaaacaattttaactaaagaaattcgtcgttttactcgtatttgggtacaaactttagtcccaccggtcattacaatgacactttattttattatttttggtcatttgattggagcaagaattggagaaatgaacggctttagctacatgcagtttattgtaccgggattaatcatgatgtctgcgttgactaattcttttgctaatgtggcgtcttcattttacagtaccaaatttgctaaaaatatagaagaattactcatttcacctacttcttctcatattattattttagggtatatggctggtggtatagccagaggtttgtgcgttggtattttagtaacaatcgttgctatgttttttgtggaaatgactgtctattcatggctaattattgtgttgacacttttaatgacaacagcaacctttgctttaggtggtttaattaatgctgtttttgcccgctcttttgatgatattagtattattccaactttcgttttaacgcctttaacttatcttggcggtgttttctattctatttctttgttacccgctttttggcaaaacatatctaaactgaatcctattgtttatatgattaatgggtttagatatggttttttgggggttagtgacgttggaattcattatactttcactgttctgacattatttattaccgcactttatggcttggtatactatctaattagtcgtggggtagggttaagaaattagccgtcagatcaatacaaataaaggcgaataatcaatactcgccttacttttatgaacctaagttttttcctttaataaacaaataaatttgcaattatttatatttgatctatttaggtagttttccttgattttctatttcatagcaaggttcataagcatcacctccaggtaatttcattctgtgctggttgatgaaatcttgcaataaattgtcgactttttccattaatacgggatcaccttttagcttgaattttcctaattctgcaattttatcttgagtatctggtttgatatttcccgctacaattcctgagaaaactcggcgtaaattagcagctaaatcaactttagattggtcaaaatgtaaagctaaatttgccatgttttcatgagttgggataaacggtttttgaaattcagcagtaatttctaatgaccagttgaaataatacgactcatttttttcataacgtgatttttggatgtcgtgcatagcattatttatatggcgagcaactgaaaccggatcatcaatgataattttatacaaagattgtgcttcagagcccaatgtatcactaataaattgatcaatagaagcaaagtaagccgcactttcttttggaccggttaagataagcggaagatgttgggcattrttatttggattgagtttaatgcctaaaatataaaggaattcttcaaaagttccaggaccgccggggaaaataataatcccatgtcccatacgcacaaatgcttctagacgtttttcaatatcaggcataataataagttcgttcacaattggatttggaggctcggaagcaataatagatggttctgtaataccaataaaacgactttgtttatagcgttgatttgcatgaccaatggttgcacctttcatgggtgcttccattacacccgctccacagcccgtgataatattcaactcacgatgtccaagttctaaacctacagaacggcaatattgatactctatttggttaattgaatgccctccccagcaaacgactaaatttggttgctcaccgttaattagggccttagcattgcgtaaaatggcgaagacttggttagtgatatgtttactgtcttgaatatcacaagggttaatgcgttgatttaagacattaacaaataaaatatcacgcagcacagcgaataaatgatattgaatatttttaatcattttattatcaacaaaagcatttaccggtgggttatgcaactctaaagcaatgccacgttctcttgctaccaaattaatatcaaaatcggaatattgatttaacaacgcacggctgtcgtccgtaattgcacctgagtttaatacggctaatgaacaattgcgataaagttgataaagcttacttttagcttttttggttaattgttcaacttccatatgtgaaagttgatccatacttcctttaggattgacataatgtatgtttttcataaaagttcctttttattggcgagcaagacgttggttagttggaatggattcaaaatttgaacgaaatggattaatatccaatccgcctcgtcgagtgtaacgagcataaacgctgagtttttccggttgagcaaatttcatcagatcacaaaaaatacgctctacacattgttcatgaaattcgttgtgttgacggaaagaaacgagataacgcaagagtttttctctgtttatttgcttaccgatataatgaatttgtacagttccccaatccggttgattggtaattaaacaatttgatttcagtaaatgactgactaatttttcttcaacccattgttcattcgtacaattttccaataaattaggattaaattcataggattgtatttcaatatcctgtgcatcaatacattcaccttgtagagtagtaatggattgttgatcataatattgcaacgaatttaaccgcacttttacttgcccttttgcacattttgctaaatcttgttgcagaatttgttcaacctgttgtagattttcaaaccgactttgattaaaactattcaaataaagtttaaaactttttgattcaatcagattttcactttgataatcaatttcaacatctgcaatcgcaacttggggtaagccttttaaatttaaccaagaaatttcataagccgtccaaatatctgcaccaaaagtaaatggctgtttttcaataatatttaaatcgcctcgattaagtttgcgtggcaccgcttgtaataaagtgcggtcataagtagagatatattctgttttttttcctaattttaatgtttgtaaactttggtcatggtattgcataatttgtcctttttgttattgccaatgccaagataaattagaaactaagcggcaatgatcacatttaaaatgaaagaggttaaataacggtttatccaaaagccatttttgctgacaattgggacataggcgttgttgttcactttgcagatccgtaccgccaatgcgataaagataataaaaagtgggaataccggtatgtttttcaatttctttggttagataataaccatgtttagttaaatgactattgagatcgctgatttcatacagtgcctgttgttctaaaattgatccgttcatttgtaattgatcgcaagcctgccaattttcttgccatttaataatatccatactcaagtgcggtatgtttttgaattgtttatacaatggaataggtaataaatcatcaccgctgtgtagtggagaacaagattgcagataggtagtataaagcacttgccaagtagttacctcttttgggtaagttatatctgaatttaaatcatctgcaacaatttgaaaactatcaaaaataattccagcactttttgcttgttcgagggcattatttacttgtatgttattaaacataggtaacaaactttgctgttcgggacaagttactcgcaacgcaaaacccttatcattattttgatctgccacaaacaatggaatttcacgtccaataatttgtccgttataacgccattgctcaataatttgattaatcaggtaagcaatattattaattggcgatttttgaggttgtcgataggtaaaaaatacttcaactagatacatacttatcgtttgataattattcggaggagtagattaacataattaatttgcatagaataccgctttttattttggaatataacgaatgaacgttgaaattaaaccgcacttacaagcgttacaaaaaattatgcaagacttaggattatggcaaacctgtcctcccgatgaacaagcttttttaagcactgtaccgttttttgtggatactatgagtgctaatgaatggttacagtgggtttttattcctcgtatgtatgcattgctggagagtcaacaatctttaccgtataaaatggcaattacaccttatatcgaagaagcattaaaagatcttgatggattaaatgacctactacagcctattcatgaaattgagaaattatgtcagagccaatagaattggatattttatatcaagatgagtttctcgttgtagtgaataaacctgccggaatgttggttcaccgcagttggctagatcgtcatgaaactcaatttgtcatgcaaactttacgagatcaaattggtcaacatgtttttcctattcatcgtttagatcgtccgacatcaggcgttttactttttgccttaaatgccggaattgctaatttattatgttcacaatttgaattaaaacaagtgaaaaaaagctatttggcgatagttcgtggttatttgagcgattctcaacgaattgattatccgcttaaagtgcaactggacaaaattgcagataaatttagtcgaaaagaagaactgcaagatgcaataacggattattatggtttaaaaaccgttgaaatgccttatggcgtagggcgttatagctcttcccgctattcacttgtacgtttaatgccgcatacgggacgtaagcatcaattacgtcgccatttaaagcatatttttcatcctattttgggtgatactcaatatggtgatttacatcaaaatcgggctttcagtcaaaatcttggtgtaagcaggttaatgttacatgctgaaaaactttgttttcaacatccggtaactaatgaaacaatagaaattgttgctgatttagatgagcaatggaaattgttattcaaaatatttaattggtaaatagctcagaacatttgaggaagtatatgttaaataatgtaaaattaactcatgaagaacagcaaagtgcggtagaaaaaattcaagaattaatgcgacaaggtatgagtagtggggaggctatagccttagttgcgaaagtgttacgtgaaaaaaagttacaccctgaatcaaaatataataaaattttgtgatctctgtcggatttttgaatattatttattgcaaatatagttaatttcgttgagtatttagttaaattttaggaaggtggtaaggctcacagtcttattatgaagtatagaggtctgtaaaggcttaaaaccaaagaggttaaaatattatggaagtaggtattgttaagtggtttaataatgcaaaaggatttggattcctgtctgttgaaagtagtgatgttgatgtttttgcacattattcagtcattgaaatggaagggtatcgctctttaaaggcgggacagaaagtacaatgtgaagtcgtgcatggagataaaggttctcatgccacaaaaattatccccatggttgaataataaaatcaaagctttttgtttcggtgtattgagcaaggttttaaccttgcttttttatgtgataaaactcgctattttagcagatctttaagaccttctttcataacggaaacttgattttcatataagaccttgctttctctttcatcaatcatataagaaatagtttccgataaagtcattttcattttacgtgaataacgagataatcgaagccagaccgcatattctagatcaattgattttttctttgtagattgtttctcgccattgaaaaaacgttttcttcttgctcttatagcttgatccaacttaataactaaatttgatgacaaatgattttctatccaatcttcaattttttcagggtagttttggtgtgtcattaattgccgaacaatgtcttcttgtaaactttgttctgtataacgtgtaatattttcaccctcgcgtgattttttgatcaaatagagccatttccaatttgcttcttgatttgtcagcttctgatatttcattttgtttactcatctgtgacattgtaacctatgtaataatatacgctttttatattattttctagtaaattttaatcaagaatacagaagtgaattaaatagaaatatgcgataatatgaccttaatcgtttaatttgatagagagtacatgtgacaattgagcaaaaaataaaaaaaagagccgacgaatgcttgtcagaacagttaatttcttggcaaaatttattacccatgttacaacttgataatgattttttagacgcttcattatctgagattgatttttttactttgcaaccaagagctaaaagtgcggttgatcttttcctaaaaaatcctcaacgatcattgcttgttttaaaagcagatgatcaagctgaatatgcaactttactacaagaatatatagaacaaaaacttcctgtttctgaaacaattagtggtgttcagtatattattgaacagggagacagtttttcttttccacaaatcagtctagcacaggcagcatcaatggaagacaactttgcaggaaaacaaaaagtggcaagtgctttatttttcgatcaaagtcagttattcggatcagttgtaattcaccccagttctcatgatattcaacttaattcaggattagtacatcaagtaaataatggtgtattgattttgagtgccggtgcattgttggagcaatttgagatatggcatcgtttaaaacacttattactaacaggtattttcagttggtattctcttaatcctttgcaaacattaccttgcacaattcctaattatcccttaaatctaaaagttatcattttaggtaatcgttcagagttggcaactctaggtgaattggaggaggaactgtatcatttcgcagattatgcagaaattgaaagttatttttcgcttaatgatgtacaggctcatcaaaagtgggcaagttatgttcatacgttggcaaaaaaacaaggaattgagctgagtattgaaggaataaatgcactttatcaactttttgtgagagaaagtgaagatcgttacttaattagtatctcaccattaaaattaaaagggatcttatttgaaacacaaattttaagtcaaagaaaacatttaagtgcggtagattttcaattattttttcaacaaaaagaacaacagtactgtttcttgcgtgagcaggcgtataaagacattttacaggagcaaatttttattgctacagatggggaaataataggacaaattaacggattatcagtcattgaatatcccggtacaccggtttcttttggcgagccttcaagaataagttgcattgttcaatttggtgatggtgaagtaattgatattgaaagaaaaagtgatctggcagggaatatccatggcaaaagcattatgattgcagaaacttgtcttgccggcattttagatcttccttctcaattacctttttcagcctcaattgcatttgagcaatcttatggtgatattgatggtgatagtgcgtctttggctgttttctgctcgttattaagtgcgttggctgatttaccgttaccacaaaatattgccgtaacaggtagtattgatcaatttggtttagtgcatgctgttggtggtgttaacgataaaattgaaggcttttttgaagtttgtcagcgtcgtagattaacgggaaagcaaggtgtaattattccaagtgcggtattaaatcaactcagtttatccagtaaagtaatcgaagctgttcaacaagaaaaattctttatttgggcagttgacgatatttttcagactactgaaatcctatttaagcgatatttagtaagcgaacaggatgctggattggaaaaaaatcttcccctcgtagatgtgattcgacaacgattagaagagagatctgaacaacagcataaaggtcgtttttggaactttttctttaatcgccattaaatgttaagaaacacgtgattttttaacaggttagtattattattaggggaattttcgtttaaacattggatttttaattatttagaggacaggtatgtataacctacaagaaattactgaaaaagctcggaaagcaattgatgcactgcaagataagagcattgaaagcttggaggcaattcgtgtggaatattttggtaaaaagggacattttacacaattaatgcaagggttacgtgatgtgtcggcagaggaaagaccggcagttggtgcaaaaattaatgaagcgaaacagaaggttcaagcgatattaaatgcaaaaaaagtggaatgggaagaaatagcgttaaatgaaagattagcccaagaacgaattgatgttagtttgccaggaagaaaaatggaactgggagggttacatcctgtttcaattactattaaccgtgttgtacagtttttttcaaaactaggatttactgttgagataggtcctgagattgaaacggattattacaattttgatgcgttaaatattcctaaacatcatcccgccagagctgatcatgatacattttggtttgatgcagaacgtttgttacgtactcaaacttcaggagtacaaattcgtactatggaaaaaatgtgtcctccaattcgtattatggcaccgggcaaagtatatcgtaatgattatgatcaaacgcatacgccaatgtttcaccaaattgaattattgtatgttgataaaaaagctaattttactgaattaaaagggttgttgcatgatttcttgcgagctttctttgaagaagatttacaagtgcggtttcgtccatcttattttccatttacagaaccttcggcagaagtggatgtaatgggaaaaaatggtaaatggcttgaggtgttgggttgtggtatggttcacccgaatgtgttgcgtaatgtaggtattgatccaaatgagtattcagggtttgcagtcggtatgggagtagaacgtttaaccatgttacgctacaacgtcacagatttacgttcattttttgaaaatgacttacgttttttaaaacaatttaaataataagggcaaaaaatatgaaaaaattaatatcggtcgtgttggttatgttttcccctcttacattcgctttttcagagggacaagttaaattgcctgtgcaggaaaaacaaccggcagcaatcattcgtgtatttgataattcggttaaaccctataaaatcattgaaggaaagaaactatctcgtagcaaaccacgtcatctttgtttatatatacttaatgtcgatcttcaggaaagaaatcttttagctcaatatgtacaagctcctgcaccgataaaggtaaatgtgccgaatgttaatgctaaagtacgcatggaagataaccagaagaattttttgattatgtttgacatgatgaaaaaagatattagagataatacacctactctatgttgggcacttggtaaagatgaccctatcggcatttacaaattggatgtgcaatttaataatgttgtgtttgaaaacttagaatttgaattattaaaatagagagagaattataaatgaagtttagtgaacaatgggtgcgtgaatgggtaaatcctgcaataagtactgaacagttatgtgaacaaattacaatgttgggcttagaagtagatgatatagcaaaagtcgcagcagatttttcaggggttgtcgttggtgaagttgtagagtgtgctaaacatccggatgcagacaaattacgggtaaccaaagttaatattggtggcgagcgtttattagatatagtatgtggggcaccgaattgtcgcaaaggattgaaagtcgcttgtgcaatagatggggctatattacctggtaattttaaaattaaaaaaactaaattacgtggtcagccatcggaaggaatgttatgctcctttaacgagctaggtattaatgaggattccagcggtattattgaattaccgcaaaatgcaccgataggtgttaatttacgtgaatatttaactctgaatgataacaatattgaaattagtctaacaccaaatcgtgctgattgtttaagtatagccggaattgctcgtgaaattggtgtagtcaataaacttgaactaaactcaccgcactttgaaccggtcaaagcaagtattaaagataaagtcactattgaagtattagcacctgaggcttgcccacgttatcttttacgtgtggtgaaaaatattaatgttaaagtcgacacaccgatgtggttacaagaaaaattgcgtcgttgcggtattcgttcaatcgatcccgtggtggatataactaactatattttgttagaacttgggcaaccaatgcacgcatttgacatggcaaaagtgactcaacctgtacaggttcgtatggcaaagcagggggaggaattggttctattggacggttcaacagcaaaattgaaagaaaatacgctgataatcgcagatcaagaggggccgttagccatggcaggcatctttggcggacaggcaagtagtgttaatgcagaaactaaagatgttatgttagaagcggcattttttgcaccattggctattgcaggacgtgcaagacaatacgggttacatacggattcttcgcatcgttttgaacgtggtgtggattttgaattggcacataaagcaatggaaagagcaaccgcacttttaattcaaatttgtggcggtgatgccggtgaaatttgtgaggctttaagtgaagcacatttaccaaaagtaaaacaaattcagctacgtcgtacgaaattagatacgttacttggccatcatattgaaacagaaaccgttactgatatattccaacgtttaggatttgcagtggaatatgcgaatgatgtctggacggttacttctgcaagctggcgttttgatattgaaattgaagaagatttaattgaagaggttgcccgtatttatggttacaatgtgattccaaataatgcacctttagcacatctacaaatgaaggaattactagagaaattattagatctcaatcgtatccgtaccgcacttgtggacagcgactatcaagagattatttcttatagctttgttgatcctgacgtacaaaaattgttacacccagaactagatgcacttgtattgccaaatccgatttcaaaagaaatgtcgacaatgcgattatcgttattgccgggcttgctgagtgcggttgtatataaccaaaatcggcaacaaaatcgaattcgtttgtttgaggcaggattacgttttgttcctgatactacagcagaatgcggtattcgccaagaatatgtgattgggggcgtgattgttggtgataaacgtcctgttcattgggaacaaaaaggtgaacatgttgatttctttgatttaaaaggtgatttagaacatattttgtctttaactcacgttggacatcgtttgcgtttcgtggctaaatcttatccggcactacatcccggacaatcggcagaaattttacttgataacaaagaaattggttttatcggtacagttcatccaaaaattgtacaaaaattggatttgtccggaaaaccgattgtattccaaattgaatggaatgcgatttctgagcgtaatgtccctactgcacaagaaatttctcgcttcccagccaataaacgtgatcttgccattgttgtagacgctgacgttgtggctggagaagtactggaagtttgtcgtgctgttggaggtaaacaactcattaatgtaaatttatttgatgtttatcagggggtaaatctacctgccgataagaaaagtttagcacttagcttaatgattcaagatacagagaagacccttgaagaaaaagatattaatgcggtaatatctgttgtattatctgcgttgcaacaaaattttaatgcttacttgagagattgattatggcactgactaaaattgaacttaaaaatagcttgattgaacagggtttaaataaattagaggcgaagaaagtagtagagggcttctttgaacaaattcgagtttcattagaaaatggtgaagatgttaagttatccggatttggtaattttgaattaagagataagtcatctcgcccggggcgtaatcctaaaacaggagaagctattcctgtttctgctcgtcgtgtcgttgtattcagaccgggacagaaattacgttcaagagtagaaaaaaccaaacctaaaaattagggattttttgtttctttaagaaaagccgtttacattaagtaaatggcttttatattttaacgtactagaaaaggtgtaatggacaaaatagttgctaaaaagtgcggtcagtattttatttttttacaccgcactttcttaccttaatttacctctttgaaactaatcatttcgccttgaataaaatctattttttcatcgttttcttgaacgaggggagtaggtgagaacgcttctttatcaaaggcaatatcaccctctattccttccggaatctttccatgtcggatacgtttaaaatcaaataagttagaatcacataaatgtgaaggcacaatattttgtatcgcactaaacatagtttcaatgcgtccgggatattgacgatcccatttttgcaacatttctttgacaacttgacgttgtagatttggttgagaaccacataaattacaaggaataattggaaattgtttggcaactgcatatttttcaatatctttttctttacagtaagccaaaggacgaataacaatctgtttgccatcatcactgatcagttttggcggcatagattttaatttgcccccataaaacatattcaaaaacaaagtttccagcatatcatcacgatgatgtcctaaagcaattttagttgcccccaattctgttgcggtgcggtataaaattcctcgacgtaaacgagaacagagagaacaagtggtttttccctcaggaattttttcttttacaataccatatgtattttctgccacaattttgtaatctacactaatgctttttaaatattcgggcaaaatatgttcaggaaagccaggttgtttttgatccaaattcactgccacaatatcaaaatgaataggtgcattgaggcgtaaatttaataaaatatctaacaaagtatagctgtctttaccaccggataggcaaaccatcactttgtctccattttcaatcatattaaagtcagcaatagcgttgcctacattgcgacgtaatcgcttttgtaatttattcaagttataactttgttttttatctttttcggtaatgatatttaaattcatacagtttctgatcttgttaagaatgcgatatagtaaaggggaattgccactttgccaacagaaaactgtgtttttaatgatctattatttaaattaagtacgagataaaagtgcggtagtttttagtcatatgtctattagaacaagcaaaattacgctataatcttgcaaaattttgcgtaaattattgcattgtgagaattgttaatgctcgaaacatcacaaactattcctgaattagtcaactggacgagagaacgagagttttctttgagtctatctacagaacgcttggcgtttttgctggctattgctatttacaataatgaaagacttgacggtgaaatgttggaaactgatctcattgatatttttcgccatatttcaaacacgtttgaacaatccgctgaaactgttagtacaagagcgaataactccatcaatgaattagtgaaacaacgttttttaaatcgctttagtagtgagtttactgaagggttatctatttatcgcttaactcctttaggtgtaggggtatccgattactatattcgccagcgagaattttccgctttacgtttatctgttcagctttctattgtagcagatgaaattcaacgagcttcagaatctgcggaagaaggcggtgatgaacattattggcgtaaaaatgtatttgcaccattgaaatattctgtagcggaaatctttgatagcattgatttatctcaacgtatgatggatgaaaatcaacagcatatcaaagaggaaattgctgaactgcttactaaagattggcaaacggctattgccagttgtgaacgtttattagatgaaacctcgggaaatttacgtgaattgcaagatacgctcaatgctgccggcgataaattacagtctcaattgttacgtattcaagactgtgtaataggacatgacaatttgtattttgttgagcaacttattgtagatttacaagcgaaactcgaccgcattataagctgggggcaacaagctattgatttatggattggttacgatcgccatgtacataaatttatccgtacagccattgatttggataaaaatcgtgtcttttcacagcgtttacgtcagtctattcatcattattttgatcatccttggttcctttggatcgcacaggctgaacgcttaattgatctgagggaagaagaattaacattacgtgaagaagaagcccttggggaactgcctgaagaattgcaatatgaatcccttgctgatttacatgagcaaattgtggaaacaatgcaatctttattgattgaatatcgtctacaaaatacccctattgatttgagtgaggttttgaccgctcaactaaaacaatacccacttgctaaacattttgatatagctcgtattattattgatcaggccgttcgtttaggtttagctcaagatgatttaaacggtatttatcctaattggagatcgattaacgaaaatggtgcagaagtacaggctcatgtaattgataaatattaacccaatttaaccgcactttttgtaactgattaatttaacaactttctgaaaagaaaagagaaaaatatgacagacaatattcaagatttactttccattaaattagctagagctattgcaaatcctttattccctgaagtggatagccaattgcgttcaggtaagcacattggacaagagtatttagataattattcatttttggcagattttcaacatgaattagatagtttctaccggcgttataatgtggaattgattcgtgctccggaaggatttttctacttacgtccaaaagcaaccacgttaatcgctcgctcagtgttgagtgaattggaaatgttagttggaaaagtgctttgttacttgtatctcagtccggaacgtttggcacaacaagggatttttactgttcaagaagttcatgatgaattgatcaacttggctgatgaaactaagttattgaaagcaattaatttgcgtgcaggtggttctgatttggataaacaaaaattagcggaaaaagttcgttcagctatcagtcgtttacgccgtttaggtatgattcatgcggtaggcgatcaacatagcggtaaatttacgatttctgaatctgtgtttcgtttcggtgcagaagttcgttcaggggacgatccgcttgaggctcaattacgtttaattcgagaaggggaagcagcaacggctcaatcattacaagaagaaaaaaatggcttgaaagataatatggatcaaagtgcggtagaaaatgaacaagattttgaaaatgaagaaaatgaggggattgcataatggcagatttagcgttacagccgaccatgtctgaagaaaacattgatcaagttgaactacaggataaacaagaacccctcgaaaattttacggcattttcgccttttcgttctcaggggggagtagcgcgaggtaagtttcgttctttaaccttaattaactggaacggtttttttgcccgcacttttgatttagatgaattagtaactacgctttcaggcggtaatggtgcaggtaaatctacaacgatggcaggatttgtaactgcacttattccggatttaactttattgcatttccgtaacactactgaagccggtgcaacaagcggttctcgtgataaagggttacatggaaaacttcgccccggagtttgttatgcggttttggatactattaattcacgtcatcaaagaactttagtgggagcaagattacaacaagtggcaggccgtgataaaaaagtagatattaaaactttttctgttcaaggcttagcattatcacaaaatccaaccgcacttttcactcaaataattgatgagcgtcaagcgaggatattaaatcttaatgaattaaaagacaaagttgaaaaactcaatgctcaattcaaacaatatcattcaataacagattatcatgcgatgatgtttgatttggggattatcccgaaacgtctgcgttcttcttcagatcgcagtaagttctacaaattaattgaagcatctttgtacgggggtatttcaagtgccattacccgatcattgcgtgattatttattgcctgaaaatttgggggttcgtaaggcttttcaggatatggaatcagctttacgtgaaaaccgtatgaccctagaagccattaagattactcaatctgatcgtgatttatttaagcatttaattactgaaacgactaattatgtagcatcggattatatgcgtaatgtcaatgagcgtttaggtaatattcaacgtgcgattaattttcgtcgagattggtataaagcaaaaggtgagcaatatttatcacaacatcgcttagtggaattgagtaaagaagctgctgatttggctgaaaatgagaaaatcttagaaatagatcatcaaagtgcggtagatcatttgaatttagttctaaatgctttacgtcatcaggaaaaaattgaacgttatcaacaagatgtgcttgaaatcacagaacgtttagatgagcaaactttagtcgtggaaaatgcgaatgagcaggtaattgacactgaagtacagttacagaatgtagaaagtgaattggatcagattcgtaatcaattagcggattataagcaagccttagatgcacaacaaactcgttatttacaatatcaacaagccatacaagcattagaaaaagctaaacatttatgtggattacctgatttagccgttaaaaatattgacgattatcaccaagagtttgcggttcaagctgatcaattaactgagaatgtactggatcttgagcaaaaaatgtctttgacgcaagttgcaaaaacacaatttgataaagcttatcaattggtatgtaaaattgccggcgaagtacctcgttcagcagcatttgagcaagctaaggaattgttgagagagtatccgacacaaaaaatacaagctcaacaagtctctcaattaagtgctaaattacatgagcttgagcaacgttatcaacagcaacaaagtgcggtacgtttattaaaagaactgaatcagcgtgcggatttacaggtcgatgaagcagaacagttggaagattattatgtagaacaagaagcattgattgaagatttaaccgacaaattatcagagcaaatagaaaaccgctctgtcttgcgtcaaaaaagggatcaactaaccgcacttcatcaagaaaatagccaaaaagcaccggcatggctaacagcgcaagccgcattggagcgtttacaagaacaaagtggcgaacattttgcagatagtcaagatgtcatgaatttcatgcaagcacagttgattaaagaacgcaacttgacgattgaacgtgatcaacttgagcaaaaacgtcaaaaattagaaatacaaatttctcgtttaagtcagccagacggctcagaggatgctcgtttaaatatgctggcggaacgtttcgggggtgtgctgttatctgaattatatgatgatgtacctattgaagatgcaccttatttttctgcgttatatggaccggctcgccacgccattgtagtacgagatataagtgcggtgaaatctcagctggataatttggaagattgccctgaagacttgtatttaattgaaggcgatccaaccgcatttgatgacaatgtattggattcaaaagaattggctcatggggtagttgtacagatttcagatcgtgagttacgctattcgaaattccctgaagttcctttatttggtcgagcggctcgagaaaaacgtttagaagaattaaatattgaacgtgatgaaatttcggaactttatgcacaaagagcttttgatgtacaaaaatgtcaacgtttgcatcagcattttagccagtttgtcgggttgcatttggctttagcatttttacctaatccggaacaaactattgctgaaattaatcagcaacgcaatgaagtagatcgtgaattaaatctacttaacagtacagaacaacaattgcgtcttcaattggatcaagccaaagaaaagtggcaattacttaacaaattaagaccgcactttgctctattggctgaggaaagtttaatagatcgtattgaagaatgtcgtgagcaactggattttgcacaacaagatgagttgtttattcgtcagcatggtgcgaatttatcgcaacttgaacctattgtaagtagtttacaaagcgatcctgaacattatgatcgtttaaaagttgattatgaccaagcagttattttgcaaaaaaaagtacagcaatgtttgtttgctttatctgatgtaatgcagcgtaaagctcattttgcctatcaaaatgaagttcaaaccgaaacttctgatttgaatgagaaacttcgtcaacgtttagagcaaacgcaacaacagcgtaatgatttccgtgaaaaattacgtcaaaagcaagaacaatttgcccaatataataaagttttaattgagctgacatcttctttgcataataaacaacaagtactaaatgagttgttacaagaagtaggtgatcttggtgttagagtagttcaaggggcagagcagttggctcaatctcgtcgagatgagttatatcaacaactttctatcactcgccaacgtcgcactcatgtcgagaaagaattaactcgaattgaaagcgaatcgcaaagcttgaatacccgtattcgcaaagcggaacgagaatataaggctcagcgtgaaacagtagtagcggcgaaaattagttggtgtgtggtgatgcgattatctcgtggcagtgatgtcgaaaaacgtctaaatcgccgtgagtttgcttatttatctgccaatgaattgcgttctatgtcagataaagcccttggtgcattacgtcaagctgtagcggataatgaatatttgcgtgattcattgcgaatttcagaagatagtcgcaaacctgaaaataaagtgcggttctttattgcagtttatcaacatttgcgtgaacgtattcgccaagatattcttaaaacggacgatcctattgatgccattgagcaaatggaaattgaacttaaccgtttaactaacgaactgactcaacgagaacaaaaattagcgattagttcagaaagtgtggcaaatattatgcgtaagacaattcaacgtgaacaaaatcgtattcgtatgctaaatcaaggtctgcaaaatattgcttttggacaagtcaaatctgtgcgtttagtagtgaatattcgtgattctcatgctatgttgctcaatgccttatctaatgaacaaagtgaatatcaagaactttttacggacagtcgcataaccttctctgaggctattgctaagttatatcaacgccttaatcctcatattgatataggacaacgtacagcacaaactatcggtgaagaacttttagattatcgcaattaccttgatttagaagtagaagtctatcgtggtgcggatggctggttacgtgcagaaagcggtgctttatctaccggtgaagctattggtacaggtatgtcaattctcttaatggttgttcaaagctgggaagaagaaagtcgccgtattcgaggaaaagatattattccttgccgtttgttattcctagatgaagcagcacgtttagatggtaaatccatctcaacgttatttgaattgtgtgagcgtttagatatgcaacttctcattgcagcacctgaaaatattagtccggaaaaaggcacaacttacaaattggtgcgtaaaatttcaggcaatcaagaacatgttcatgttgtcggattgcgtggatttggtgcaacagagtagtcaaataaaagaaagtgcggttaaaaataagtaatttttgactgcacttttttgaggaaaataatatatgttggttttcaaaaaagaaaaaaaagaaaagctatctcttttagaggagataccttttaaattggaaaaggacattcaacgtctttttgaacaaaatctatcagaaatcacatcttatgatttggtcaaatccgaattttcaattaaaaattatcgcattgatacattagcttttgacgaggaaagtaattttttgttattattgaatataaaagaaatcaaaatattagtcttgttgatcagggaatttcttatcttaatttaatgcttgataataaaggtgagtttattcttgaatataatgaaaaaaatgaaacaaaatcattaaaaagaaatgaagtagattggtctcagtcaaaaattatttttgtgtccccatcatttactgatttccaaattcaagctacgaattttaaggatttgcctattgagttatgggaaataaatcaattcaatcaagatattataactatcaaacagattaaaaaatccaaatctgcacctagcgtaaaacagattaaggttacccaagattcatctttagataaattaacgaaagagattaagatttatacagaacaagaacatcttgaaaatcaatctgatgaaataaaagaactctacgatgaatttaagcaagctattttgaaattagatagtgaaatagaaatagttgccaaaaaagtttatatcgcatttaaaaagaaatctaatattgttgatattcaaattcagaagaaaaatttaaaactatggatcaatttatctaaaggaaaactagatgatcctaaaaaactagcagttgaagttgataaaaaagggcatcatggtaatggagattatgaattaaccattaaaaatactgataatattgaatatattatgagtttagttaaacaagctgtttaggagaaataatgcaatatcttattcttgccgttttatgtagtgtttctgtttccattttatttaaattcaccaaaaaatatcaaattgtaaccgcacaaatgatcgcttttggttatgtggttgccttgtcattgagctattttttattagcacctaattttaaaggacttacttttaccgaattttttgcacaaagtgaagctaagccgatctttatcagtttagggattttattgcctgtcggttttttagtgatgtcgaaagcagtggagtatggcggtattattcgcacagatgctgcacaacgtttggcattgttcttgcaaattatcgctgcagttgtgattttcggtgaaaccttaagcgatatgcgaattgtcggtatcattgtcgcatttttcgctttatttttcctattaagcaaacctgccggagggataaaaagtgcggtcaaagccgcttttgctcttgccggcgtttggttaatttggggagcaacagggattttatttaagaaaattgcactaatgggcggtgcatttcctacaaccttgtttatcacttttgtcctagccggtgtgattatgtttatctacctattaatcaaacgcactaattggacagtatccagcctgattggtggcattattttaggttgtttgaatttcggtaatatcctgttttatatctacgcacatcaacatttcaaagaaaatccaaccattgtttttgccacaatggatctcggcgtaatctgtcttggtacactagtcggtgcaactatatttaaagaaaaaatcagcaaattcaatggtattgggatcttattaggtcttgtcgctattttgttgttacgggtttaggggaagattaaatgacaatcagcattcaacaacgttctgaactccatcgccaaatttggcaaattgcaaacgaagttcgtggagccgtagatggttgggattttaaacaatatgtattaggcacactgttttaccgctttatcagtgaaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaaatggtacagatttaaatgaccttctacctaaaatgagcccgcttaacccacaatataaaatgaaaaaacagacggtgtttgagaagatttccgcctttgtggaaaaatttaaggggattgggggaatgttttaatgaattctacaaagtgcggtaagttttttaaggtttttgtgtatgcaaaatgatttcagtttttttatctacgattacgaaagttttgggattaatcctgccactgacagaccggctcaattcgccggtattcgtacagatcaagattttaatattattggcgagcctgtaatgttttattgtaagcaaaccgatgattatttaccgtcgccggaatcagttttggtaaccggtattacaccgcaaatttgtaatgagaaaggtattcccgaaccggaattcgcagagaaaattttagctgaatttagtcaacccaacacttgtattatggggtataacaatgtccgttatgacgatgagatgacacgttataccttttatcgtaactttattgatccctatgaatacagttggaaaaacggcaattctcgctgggatttaatagatgtagtccgagcttgttacgctttacgtccggatggaataaattgggcttacgatgatgatggaatgccgagttttcgtttggaaaaattaacacaagtaaatgatatagagcatggtaatgctcacgatgcaatggctgacgtctatgccacgattgcaatggcaaaattgattaaacaaaaacaaccaaaactttttcaatttttctttgaaaatagaggaaagagggaagttgagaagttgattgatatcgctaatatgaaacctttagtacatgtatcaggcatgttgggtaattatcgaggtaataccagctgggttgtgccattagcttggcatcctataaatcagaatgctgttattgtttgtgatttagcaaaggatattgatgacttattggctaaaagtgcggtcgaattacgtcaaaatttgtatacaccaaaagttgaattggaacaacataatattttacctgtaccacttaaattagtgcatattaataaatgtcctattcttgctcctgcaaaaacattattgccggaaaatgcaaccaaattgggaattgatcgagaattctgtttgcaaaatttgcaaaaactgcgtcaatctccagatattcgagataaggtcattgaaattttccatgatgaaagagaagtaatacacagtgataatgtagaaactgagttatacaatcagtttttcagtaataatgataaaaacaatatgacgattttgcgtcaattatctccggagaaattaaacgagcataatttatctttttcagataaacgtatcccggatttattatttcattatcgagcaagacatttctataaaacgcttgatcgctctgaacagataaaatggcaaaaatatcgccaacgtaaactggaaaaaagtgcggttcaatttgaggaaagtttacaacgtctagtagaagagtatcaaaataatcctgaaaaattattgttgttacaacaagtatatgaatatggagcaactttacttcgtaagttatattgataatagcaatatctagaaatgcaggatgaaaaggtatttggtaaataaaataaaagagacaacgtaacaactataattttatttactaaaatttatagaggagaagagggttgaatattttaattgattttgatggtacttgtgtaacgcataattttcctgaaataggcgaagatattggtgctgcacaagtattaagagatttggttaagaatggtcataacttgattttattcacaatgagatcggaagattgttatcttaatgatgcgttggcatggttcaaaaataatgggattgatttatacgctgttaatatcaatcctgaacaatctaagtttaccagttctcctaaagcctatggagatcttattattgatgatattgcattaggcattccgaaatggtcctgccatttttatcgcccttgtgttgattggaaattggtatcggaaatgctgtatagtcaaaaattgctaacatttgaacaaatcaataaatatgattttagcatgagaaattatttataattatgaaacgttttaaaagcaacgttcacagctatgcgaggacgttgctttttttgtagcttttatttattaagctttttctccttaagaccacactacaaaactattacaaatcatatctctatttaataaagttaaataatgatacctttcaatgtacaagggagtctttatctgtcttgcttagctggtataactggcttgtgcataactttgtgatttaattatatcgtagttttcactaaccgcataactaatttcatataatgtatattatgttaaattaaatgattagatatgtaacttttggactggtttgcccctctattttgctatgaaatcttctgttaattagatgagattaaaaaaataaaaacgataaaaataaaagcgagttttttatttttttatgtttgatacagtgtcactaaattnnnnnnnnnnnncataaaaaaagccccatgattttcatcatgaggcttaaaattttgaaaactttacttatacacgtttaaaatcaatatggactaattttggcttgaatggatggcgttgcatcgcttgtactttaacagaaatttccttcccttcaataactaggataatagtatccgaatagaaagaatcatgaatttgagcgttatttaattcatcatgatttaatacaattgaaacaggtgcttcactaccaccataaacgatagcagggatttgaccattatgacgcaggcggcggctcgcacccttaccttgcttagaacgaacttcagcgttaaatttaaatgacattttttatgttctcttgaataaaataaaaaaacaaaaaaaccgcaggcgacccagcgatttcccttacgttatgctaaaacttatagtctcgttttagacatggtgctgattataatgagttattctctataaatcaaataaaacattgaatttaaactggatatttctactaaaaaagctaaaatagccgtcatactttcttattataaatgggtagttcatggacttattaattaatttttttactgattatgggtattttgcagttttctttgttctcattatctgtggctttggagttcctattccggaggatattactttggtttcagggggggttattgcaggtttataccctaatgaagttaatgttcatatcatgctgattgtgagtatgcttggtgtgttaattggtgacagtacaatgtattggcttggtcgcatttatggtgtgaaaatattaagaacccgtttaatcaaaaaaatagtaacccttaaacgtttaaaaatggtgaaagaaaaatttgctaaatatggcaatagagttttatttgtggcacgttttttacctggtttaagggcaccaatttatatgatatcaggcattactcgtcgtgttagttttattcgttttctcctaattgacttttttgctgcaattatttcagtgcctatttgggtatatttgggtgattttggtgcaagcaatctagactggttacatcaacaaataaagaaaggtcaatttgcaatttatatcttaatacttctactcgcattgttcttattttggaaatggaaacgtagtaagaaaaaagatatgtaatttagaccatcttacagggcgtatttaattatgccctattttatttacggtatagtgattcgtaaaaaataaccatactcttctactttcgatacactagatatcgtataaaatattggggatatataatttaaaaagggtactataaaaagtaccctaatttatctttaaattaaagtgcagattttgctttctcaactaatgctgtaaaagcaactttatcaaacacagcaatatcagccaaaatcttacgatcgatctcaacagatgcttttttcaaaccgttgataaatttgctatacgataaaccgttttgacgagtagccgcattgatacgagcaatccatagttgacggaattgacgtttacgttgacggcggtcacggtaagcatattgaccagctttaattactgcttggaatgcaacacgataaacacgtgaacgtgcaccataataacctttagctgccttaagaactttcttatggcgtgctcttgcaataacaccacgtttaacacgagccattatctaatctcctattgtccatgaatcttaaaaaatttaactaatcgtatgattgtgcccaaaacgctatttatgcgtatggtaagcatgctaccactaaaacttggtctgctttcgcaaccattgatttatgacgtaaatgacgtttacgtttagttgtctttttagtcaaaatgtgacgtaagtgagattgtttacgtttgaaaccacctgaagcagttttcttgaaacgcttagcagcaccacgtaaggttttaattttaggcattgtttataactccgcattgtttaagtttaacatcagataattaggcgaataaaaatacggcaattcataccgcactttactacttgaatttgcactaattatttctttttgggggcaagtaccataatagcttggcgaccttctaatttgccaggtgcagattcaacaacagcaatatcagcaagatcatttttaacacgttctaacatgtctaaaccaatatcttggtgagccatttcacgtccgcgaaaacgaacagtgattttagctttatccccatcctctaaaaagcgaatcaggctgcgtagttttacctgatagtcgccttcgtctgtaccaggacggaatttaatttccttcacttgtacaactttctgctttttcttctgctcttttgcagctttacctttttcataaaggaacttaccgtagttcataatacggcataccggtggttctgcatttggactaatttcaacaaggtctaaatctgcttgctctgctatatttaaagcttgttggatagatacaatacctacttgttcgccatcttggtcaatcaaacgaacttctttcactctaatttcatcattaatacgattagggcgatttgttgccggagctttttttacggttttaataatgttattcctctaacgattttaaactaccatcaaactgcaatactgcagaagacataaacgattgctgtatttttagcaaaaaacggcgagattttataagattttcaattactatgcaaggtattaaggcatatattgacaagttttataaataaatgcacttaataaaatacatagaacgcatagaatttgaataagttttttctttgttagcttttctgccggcataactagtttcctttgcactttttaaatttaaaacttcttaattattttatttaatgttatcatttcttgagttagatcaagttttgcattacacgcttttatctcagtttcaatgcttttgaggaatgaatgaaaacttttccctatgaacaaaaaattggacgacgagttcaatctactggttgtgctattcactgtcaagcttgtagtattagtcaactatgtattccgtttatgtttaatgaacatgaattagatcagcttgataatattattgagcgtaaaaaacctattcaaaaatctcaaattttatttaaagcaggcgatgaactgacttctctctatgctattcgatccggctccattaaaagttatactattggtgaaactggagaagaacaaatcaccgcctttcatttacctggtgatttagtaggatttgatgcgattaatggtatgcgacattttagttttgcacaagctttagaaacatctatggtgtgtgaaattccttttgatattcttgatgatctatcaggaaaaatgccgaaattacgacaacaaataatgcgtttgatgagtcatgaaatcaaaacagatcaagaaatgattttgttattatctaaaatgagtgctgaagaacgtctagcagctttcatccataacctttcaaatcgatactctgctcgtggtttttctgcacgagaatttcgtctaacaatgacccgtagtgatataggtaattatttgggattaactgttgaaacaatcagtcgtttgctgggacgttttcaaaaaaacggtcttttatccgtgcaaggaaaatatattactattaataatatgtcagaactttctacacttgcaggaacgacaaaacctaaaattaaaatgatcggataaaaacttggactcaataataagttactactttcgatcattttttaaagtacaattacttgtcatttttataaatattgcctattctatttctatagtttgtttccactggaaaaatatgtttattgtttttgcaaaatatcggaggttattatgcaatttaataatatacttgtcgttttaaatcccgaatcagaaaagcaatatgctttggctcgagcagttcgtttggtacaagaacaaaagagcgagaatagagtaagaattacaacttttatgacggtgtatgatttttcttatgaaatgtcaactttgctttcttccaaagaaagagaaacaatgtgtaaaagcattattaagcaacatcagcaagctgttcaaccatatctcgaaaaatatgcggatccgaatattgaatttaattcaattgttctttggcacagtaatgaagcggaagctattacaaatgctgttgcggaacataattatgatcttgtcattaaatatactcaggagaaggaatctttatcggcattaatttttacacctcaagactggcaattactacgcaaatgtcctgcacctattatggtagtacgtgatggaaattggaaacatcaacgtcgaattttggtagcggttaatgtttccaataatcaagaggaatatacttcattaaataatgaacttgtttctttaggaattgatttagcggataaattagaacgaggtaatattcatcttgttaccgcttaccctcccactccaattaatatggcaattgatttacctgaatttacaacaacagaatatggtgatagtgttcgtggacagtatcttttaaatatgaaagcattacgccaacaattttgtatagatgaagaccatactcacgtaagagaaggatttcctgaagatgttattcctgctgtcgcaaaagagttggaggctgaattggttgttttgggaacagtaggaagaacaggactatctgccgcattcttaggaaatacagcagaacatgttattagcaaattagaatgtaacttgttggcaattaaaccgagtaaaaaataacaaaattattacacgaaaatcctaacttaatcgttaggatttttttaaagtaattttaaaaatgtgcctacggtatagaatgagccaaatactaaaataatatccttttcagtagcattttgtaccgcactttttactccctcatatacagaagaataagtttgagcagatagctcattagttgttgatatttgttgtaatgtcataaataattcatgactactctgccctcttacgccatctaaggttactaaattccactgatcaacaactttgattaaaggcgataatattccttgactatctttatcttttagaatgccacataccgaaataatttttccgattgatttagctttaagtgcggttaatctttctaataaataggaagctgcatgaggattatgaccaacatcaacaataatttgaggtaattgtttaactgtttttttacttaatttagctaaatttaataatttttctgggttgattttctgaaaacgccctgccagttcaacttctctaagtgacttatgaacaactgatatagaaatatcaaaaggtaaataagccaacgttgctaaagctgttgcagcatttgccaagggaatactacaaataggtaaattatccatataaatagctttatcaccttttattgtttcccatgtccagccattttcctgtttactgaatttccaatctttattacgacaaaataatattgaatctaattttttcccttgttctaataaagaacagggaatattgttttcaccaataacggcaggcttatttggacgaaaaatacccgatttttcaaaagcgatctcttctcgagtattgcccaagaaatccgtatgatcgatgtcaatactggtaattacggcaagatctgcatcaacaatattagtagcgtccaaacgaccgcctaaccctacttctaaaataacaacatccaaattagcttgcttaaagagatacaaagcagaaagtgtactaaactcaaaataagttaaagattgtgatttatgttgctcaataaaagcaaatgcttgagtatgttcttcatcagctaattcttgattttgaattcttactctctcgttataacgaattaaatgaggagaggaataaacaccaacacgaaatcctgagtttagtaataatatttccagtagacgacatgtcgtcccttttccatttgttcctcctacagtaataacaaaaggagcaggctgtaataaatctaattgttgtgcaactgttgtgaccctatctaatcctaagtcaattgctttagcatgtgctttttctaaaaaacaaagccactgttcaagtggcgatgttgcaaataaatttaaactagacatcatcagatttttcttgaattaattcaggttcaacaaaaggggaaggcatattcatgagcttgcttaaaagattagctaaagtttcacgcatctcagaacgtttaacaatcatatcaatagctccatgctccagtaaaaattcactgcgttgaaaaccctctggtaatttttcacgcacagtctgttcaataacacgaggtccggcaaatccaattaatgctttgggctctgcaatattaatatcacccaacattgcaaaacttgcagacacaccgcctaaagtcggatctgttaatactgaaataaaaggaacacctttttctttcatctttgccaatactgcactggttttagccatttgcattaatgagaacaaagcctcttgcatacgagctccgccacttgccgaaaaacaaactaatggacaatgtaattctattgctttttcagcagcttgaacaaattttgagcctacaacagatcccatagaccctcccataaaactaaaattcaaggcagccacaacaattggcatgccataaagagtggctgaaacagtaatcaacgcatctttttcgcctgtttctttttgggcggctgacagtctgtctttatatttttttaaatctctaaattttaaaatatctttaggttctaaatctgcagcaatttcaacaatgctatctttatccaataaagcaacaaggcgttctcttgcatcaatacgcatatgatgaccgcactttggacaaacttctaaatgacgttttaattcatcacgatacaacacttgctcacaggaagtgcatttggtccataccccttcaggcacatttgattttttgctatttgaagttgtatttttactaaaaattctatcaatccagctcatgtttaaccttttatttattaacttaaaactcgcctcattagaccataagtcgggggaattttccagaatttaacaactccgactagcctattaattcaagcaatttaactgccattaacgctagattaaagtgttgctcatcggctacagaccaaaattctattttattttccgccgcacttaatgtactaatatgcaatttcactttttcctcattgttttcattttctccgtgagtaaccggcgtaattaatttctctgcatgatattgaattagctcattttcttgccaaaaatgtaattggctttctatatcaaccaaataatctgaaagtgcggtcacaaactgccccattccataaaatacaggcacttgaatttgatgaaagacaatattctctaattgtgggtaaattttttgtaactgtataactaaattttgagtttgtacaggaaagacatcaaaggctaaacgttgctgttccgtatccagcggaatcccatttaataattgagctgtctgtccggccaatttggcaacttgttctgcttgtacataggaagcgggtaataatgaagtcacaaccaattgatgaatgctattaacaatattactgatagctaaagcacattgcgttacttgtggatttggaagggaaacaatatttctttggcgtaattcaatcaattgatcgtcattaatacctggtacaacaaccggaatatttgcaaggcttgcacaaatgcccagcacatcgatcacaatacaacctgaatcagctatttttgccaaaagatcaacatgctcaattgtccctgcaaataaaacataattaaactctgtccaatctgcatcttcaggcataatttgaataactgctttattgttaaaacgaatgccttgctcttctttgaaaggctttatttcaataattgtcaagctttcaatttcaagctgagtgtgttctaaagtttcgacaattttctcagataactcaaattctgctgcaatagcaatacttaacatttttctctcttataaactcggatagaatgcagtgcattttacaaaataattaagggaaaagaaaatgctcctgtaattatttactaggaatattgctcagaaaattaacgcaataaatcccaaacaggacgacaattttccggtaacactagagattttcccaattcaatccaattgcttggaaaatgaaaatcggaaccaacggaactgtataaatcgtactcttccgcccaatgagcaagtaataaacgttgatccttggtttgtccacaacctgctacttctattgcatccccaccccactgtttaaaatcagcgataagacgttttatcttttttgttgtcatagtatagcgtaatggatgagcaagcactgcaattccgttggcttgatgaataatctctattgcattagggatatcaacccattgtgttttgacatatgcagattttccttgtgctaagtattttttaaaagcttgactaatgttaataaccttgcctatttgcactaaataacgggcataatgtgctcttgttacttctccatccgtcagtttttgcgtttctgcaaaggcgttggctacacctaaatgctccaattttttaccgatttcaaccgctctttgtaaacgaatttttgcctgctcattcaaaagtgcggtcattttttttgaattttcatcaaaacctaatcctacaatatggatactataattttcccaagaagtagaaatttcaacaccattgatcagtgaaatgcctaattgttctgcctgagtacgagcttgcgataatcctgcaatagtatcatgatctgtcaaggctaaaacatttacaccttgttgatgtgcccttatcactatctcttgtggtgataaggtaccgtctgatatagaactatggcaatgcaaatcataaattttgttcatactttcctaaattacttatcaaaaataaaaagtgcgataaattttaccgcactttcacttagttatgtgtctgttttcgctattgaagggctttttctattttctcaaacaaatctttcgacaaattttccacttcgcttaagcgaactaaagcacgtttcatcaaagtttgccgttgaggatcaaaacgagagaaacgaattagcggttcaattaagcgtgaagcaacttgaggattactttcatttaaccttaacaggatctcagttaaaaaacgataacctgaaccatcgattgcatgaaatccttttaaattatgtacacaaaagctaccgactaaagctcttaaacggttaggattattaaaattaaaacttggatgctccattaattgttgcacatagtccaaagtattgtcttcaggtcttgtagcttgtaaggcaaaccatttatccataaccaaaccgtcttgttgccatttttgctcaaaatccgctaataattggtctcgacaaggtaattgagcctgtgttgccgattttaaagcatttaaactgtcagtcatgttatttgctttgacataatgtttattcaccaaattgttacctaaatctgtataagccaaataattcaaacagagattacgcaatgctctcaacgcaatatcttgctcagttacttgatatgtctctaactgaatttcattataaattttcaagaataactctttcaaattatttgcaatatggcgttgcataaattctcgcactgcataaataccgtccggatcgatcgttttgaataattcggcaaattcagtttcttttggcagtgttaaaatcgttgttactaaaccaatatcttgctggtaattttctaatacttgataaagtgcggtaagaatttcagcagaaaactccagtgccagtccttgttgataatgaattaagttacgtcgtaactctgcattaaataacatttgagccgcatcccaacggataaaatcatttccagcaaatttcaacagtatgattaattgttgtgtattgtaagcataatctaattttaccggtgcggaaaaatcacacaataacgctggtacaggacgtgtataaatgtgttgaaattcaaaaacttgttctttttgtgtaagatttaatacatcagaaagatctttgccatcagcctgtaaaaattgctccacaccgctttcatcgtataaagcgatttttattggaatatgtaaattgactttttccatctgatcggcagttggcgaggtaaattgtgagattttgagttgataaacgtgatttttttcgtcataaaaatctgttacaaccaattccggcgtacctgattgactataccaacgacggaattgggttagatcaagtttattggcttgttccattgcaaggataaaatcttcacaggtcgccgccttgccatcatggtctgcaatataacgttgcatacctgcctgaaaacctttttctcctaataaagtatgaagcatacggatcacttctgcacctttttcatatactgtaactgtatagaaattattcatttcaatcactttttccggacgaattggatgtgacatcgggcttgcatcttctgcaaattgtactgtacgtaaaaattttacattattaatgcgattgattgctcgtgaaccggtatctgatgagaactcttgatcacgaaatacagtcagcccctctttcaaacttaattggaaccaatctcgacaagttactctatttcctgtccagttgtggaaatattcatgtgcaattacactttcaatcgctaaataatcttcatccgtggcagtttgcggattagccaaaacaaatttagaattaaagatatttaatcctttattctccatggctcccatattgaagaaatcaaccgctacaatcatataaatatctaaatcgtattctaaattgaaacgtgcttcatcccacttcatggactttttcaatgcactcattgcccaatgagcacggtcaaggttaccccgatcaacatataattccagtgcgacattacgaccgctctttgttacaaaattatcctgtaataagtcaaaatcacctgcaactaaagcgaataagtaacttggtttagggaaaggatcttgccattcaacccagtgacgaccgtctttcatttcaccacaagcaagacggttaccgttcgataaaagataaggatatttagttttatccgctgtaatttttgtggtatagcgagcaagcacatcgggacgatccaacatataagtgatttgacggaacccttctgcttcacattgcgtacaaataccttcaccggattgataaagcccttgcaaagatgtatttgcactagggtttagatgagtaacaatttctaattcaaaggtatcggcatttacggtagttaaatccaacacgaggctttcagcatcttgttgataatatttaaactcttcatcattgagtttgactgaaacaaattgaaaactatgaccatcaagacgtaactgtttgctttcaggattaagacgttgaaattgacttattgctgttacgatggtttgttgcggatcaagttgaaaatcaagataaatatcagtaacagtaaaatcaggggattgataattctttctatatttggcttttttttgcataatgacaacctaaatttattgagaaaaactatgctaggatatgatttttcgctaggtatttcaagttataacaattaagggagcgtttcgctcccttttgaagttttgttaggctaattttaatggctcaattttccatattttttctgcatattctaaaatagtgcggtcagatgagaagaaactcatattcacaatattttgcaatgcactttcaacccaagcatcttgatttttatatttttcatccactgctttttgcatctcaacatagctacgaaaatctgcaaaagattgataataatcgtaagaacgcaatgaatttaacaaatcatgatagcgagtaggttctttgggtgagaaacgacctgcattaatctgatcaataacttcacgtaattgttcatccgactgataaatatcaaatggatgataaccattacgccgtaactcttctacttgctctacggtattaccaaaaatgaagatattatcttttccaacattttccaatatctccacatttgcaccatctaatgtccctagcgttaacgcaccatttaaagcaaatttcatattgcttgtaccagaggcttctgttccggcaagcgaaatttgttctgaaatatcagctgccggaataataatttgggcaagactgacactataatttggaataaacacaacttttaaacgaccttgtaaacgatcatcattattaatgatatttgccacatcattaattaggttgatagtttgttttgctgccgtataagctgaagctgctttaccggctaaaataaagacccgaggtgtccaatctttttctggattagcaatcatttcattgtaacgagcaacaatatgtaacacattaagaatttgacgtttgtactcatggatacgttttacttgaacatcaaatagagcgtttgaatttaattcaatacctaactcctgttttacataattcgctaaacgttgtttatttttacgtttaatctctggaattgcttttttcaattcaggatcttgaatatgtgctttaagcgtttctaattgagttaaatctttacgccattcagtgcctatatatttatcaaataattcggataaatcaggattcgctaccgcaatccaacgacgaggggtgattccgttagtgacattggtgaaacgttcaggataaatgcgataaaaatctgcaaatgtagaacttaccattaaatccgaatgaattgctgccacaccatttactttatgcgatccaacaacagatagccaccccattctcactttacgtatattaccttcctcaatcaatgatatacgacgaataaagtcgttatcagtagtaacagaggtgcggacatattctaagaaataatcgttgatttcaaagataatctgtaaatgacgaggtaatatcttcgccatcatttctaccggccaagtttctagtgcttcagacattaatgtatgacaagtataagagaatatctgacagcacatatcccaagctttttgccaagtatatccttcttgatcaattaaaatatacatcaactctggaatagctaaagcaggatgagtgtcgtttaaatgaattgcaattttatccgctaaattatccaatgtattataaattcgcttatggcgtttaataatatcttgtagagaagctgaaactaaaaaatactcttggcgtaaacgtaattctctgcctgcagctgttgaatcatccggataaagtactcgagaaacattctcactagaagatttctcttcgatagcatggaaataatcaccacgattgaatgacactaaattaaaagtttcacctgcgtgtgcgctccataaacgtagtgtagctgcactgtcattgctatatcccggaatcatttgatcgtaagcaagtgcggtgatttcttctgcatttttccaaatacattttttcccttcaaaataaatatgccctccaaaacggatattaaagcgtttagacggacgaataaattcccaaggataacctttttctaaccacgcatcaggtttttcaacttgtttaccatcttcaatatattgctgaaacataccatattcataacgaataccatatcccataccgggtattgcaagcgttgcgatagagtccataaaacaagctgctagacgacctaatccaccattgccaagaccgggatcaacctctttctctaatacatcttctaaatcgacattaagatcagacaacgcatctttagctaaatgatatacgccttcagaaattaaggcattagataaagtacgccccatgagaaattccattgaaagataataaactcgccgagtttcttcttttcttgcttgacgagcagtggaaatccacccctcggttactaaatcacgtatggcatataaagttgcatttagccaatcacgttgacttgcctcctccggggaacgaccaattaaaaaaactaatttatatacaatcgatttcttcaacgaatccttcgtattttccggacgattataagaaaaaggaaggggaagtgtatttaccattaggctcaaactcctgatttaataaaaaactaccgaattttattcatctgtataaaaaaaacaataaaattttataaaaaataatttgaatatttctactcaaattatttcgctaaaaaatttatttatgtaaaagaatatcatatagggattgatatccttttgcagatgtctgccaactgaaatcctgttccatagcattgactatcacactttcccattgacttggtttacgccacaaagtaaatgcactatcaataccataacataatcccccaacatcagcatcattaaatacaaatcctgttgcatgacgtgctttgatgttttcactgctactatcaatgacagtatcagccaaaccacctgttgaacgaactaacggtaaagttccatattttaatccgtataactgcgttaaaccacaaggctcaaaacgacttggaacaagaatgacatctcctccggcaatcattaaatgtgataatgcttcatcatatccaatttttactgcgatattttccggatactcttgtgcaagccaattaataccggcttctaaatgtgctgaaccggaacctaaaattgctaattgcccaccttgttgtacaattctctcagcactaccaattagtaaatctacacctttttgctctgttagacgtgtaaccattacaaataacagtgcattaggattttgtggtaaattaaaataagcttgtaattttattttattcttacgtttaccctgcattgatttcaatttgtaatgatcttcaatatacggatcactatacggatgccaaattttttcatctacgccattcaaaataccaaccaatcgtccctgtgctttcaaagtttgcaacaacccttgtaaaccataagcaaattcaggtgttgtaatttctttggcataggttggactaactgcagtagaaatatcggaataatacagtccggcttttaaataagacatttcaccatataattccaatccatctacattaaacatccaccaaggcaatccaatttcagttagatgataaggtaaaaaacgtccttgataggctaaattatggatagtaaacaccgatttagcaggacgtcctttatgatgcaaataagcagctgttaatcctgcatgccaatcatgagcatgcacaatttcagcacgccaccaaaagtctaatcctgtagtcaactctgccccaacccaagccaataaagcaaaacgcttatagttgtccgtataatcgttataccacatatcatgatatggattaccttcacgggcatataaatgcggtgcatcgattaaataaacaccaataccattgtattcaccataacgtagtacaacatgtccggcaaaattatcaaattcagcaactacaacggtatttggaataccacgagaaatagcaggataagccggtaaaacaagtctggcatcaataccaatttcattttgtgcaaaaggtaaagcccccattacatcagccaatccacctgtttttaataatggatataattcggaacaaacatgtaatactttcattgttaattttaatcctcccatcaaggcggtaaaaataaaaaattctaccgcacttatttatgtttacacctagtctaaatgaatttcagcgacaactttttcgccatttaattttttcatcatcgattcagttaccaaaataacttttccggtactacttacacggaagcgtttgcgatcctcttcaatatttacaccaataaccgtgttatctgggataactacttggcgatcaataatacaattacgtaaaatacaatttttaccaatagttacttgaggcaacaccactgaatattctactttagaatcagctttcactttcacttgatcaaataacacagaataactaatttctgcatcagtaatcacacaaccaccggaaataagcgaattatctaccggtttaatatcttgcttgttatagaagaattttgatggataagtttgggtcggattaccgcgaattggccagcgttgatcataaatatccaattgcggatgttcagatactaaatcaatatttgattgccaaaaactatctaacgtccccacatcacgccaataaatctccccatccgtattacgtcccatacaagatcggctaaacggatgtgcatataaaacttcttcctctaaagattttggcagaatatctttaccaaagtcatgagaggtatacggtgtatttacttcacgcatcaatacatcatatagataatctgcatcaaacacataaattcccattgaagctaaagaagtatccggtttatttggaatcgccggtggatcttttggcttctcaacaaatgcttttactttcaaattttcatccactgccatcacaccaaactctgatgcttgttcacgtggaacttcaatacagcctacagtacattttgcattgcttgaaacatgatctaagagcatttggctataatcttgtttataaatatgatcaccggctaaaattaaaatatattttggacggtaatgatcacgaataattgccatattttgataaaccgcatcagctgtgccacgataccaagtagaatcatcaatttgctgacgtgccggtaacatatcaataaattcaccacgttcttgcggtagaaatgaccaccctttttgtaaatggcgtaataaagaatgagcagcatattgcgtgacaaccccaatgcgatttaagccggagttaatacaatttgataaagcaaaatcaataatacgacggttgccaccaaaatataaagctggtttagcacgtttatctgttaattcgtgaagtcgtgagcctcgacctccggcgagaattaatactaaggtatctttaacaagtttatgtttacttaaatttttagtaatactgttactcatagcaactccttatcttttatttttatactcacgactaactcacatttacttgagttattcactttttctgcaacacaccaaaagccaaatccgtcatctccaactgcttgttttctaaatgtactacttttgaataacacaaaatctcccaattgccttgaggtaataagaatttttgtgaacttgtttttgcgttgataacgaacaggtatttactgtccagcaaaatctgcagagctttgctccctttattatgccactcatctaatgacatcttctcagcatcaatatttaaccaagatacattgctctcctgccaccaattatcccgttgtaaactcggaatttgtttacgcaatgcaataacttgcttaaccaaattaaagagatcttgttcaaaatattgccattttaaccatgttgtttcattatcttggcaataggcattgttattaccgtactgcgtattaccaaactcatcaccagccaatagcattggcgttccgtttgataataacaagctcagtaacaacgcactacgacttaaataacgagcttcttcaacaagagaatttccctctttatatccttccataccatgattataactataattctcactccgcccatctcgattatcttcaccatttgcccaattattcttttggttataacttactaaatcatgtaatgtaaaaccatcatgtgcggtaataaaattgacagaattatgtggtaatttcccctgacaactatatatatcactcgaacctgcgaaacgctctgcaaaaacaccgagttcaccgcttttccataaccaaaaacgacacatatcatcacgaaatcggtcattccattcagcaaaatacgctgggaaattacctacttggtatccgcccatacctatatcccaaggttcggcgataaatttaactttttgcaaaattgagacctgctcaatttctttaaataataaggcattagcattaaaatccggcgtttctcgtcctaaaactgaggctaaatcaaaacgaaaaccatcaacatgacattcttctacccaatagcataaacaatcaattatccattttcgtcctagttcagtggataaattaagtgtatttccacaacctgttagattaatgtagtttcccgcttcgtcctgccaataataagtccgatcatcaattcctcgttgactaaacgttggaaaatgcttttccgattcaacagaatggttgaacactacatctaaaatcacctcaattccctctttatgtaatgcttttaccattgatttaaactctgttaagggtgttgtatcggcttgatttgaccaatatttggactcaacagcaaacatcgctaagggactataaccccaataattctgtagtcttttctcctgcaagtgcggttcatctaaatgataatttattggcaataattccaccgcacttacacctaattctttcaaataggcaatgacattttgatgagctaaacctgcataagtccctcgaattgcttccggaatgtcctctcgcaactgagtaaaaccttttacatgcaattcataaatgatactttctgaccaaggtgtttggggtaaaatatctccttcccaatcaaaagatgacgattcaattaacgctttaggtgctaaatgtgcattatctctctcatcttcaagtaaaaaccaagctctattttctgcacaacttaaatcaggtttaccaacaacagcttttgcgtaaggatctaacattaatttatttggattagataaagaaccatccacgccatgaatacgaaaaccatattcggttccatattccaattcagctacccaaatatgccatatattttctgtacaatacattgaataacgggtttcttgaacagaatttttattaaaaatacaaagttcaaccgcacttgcctgtgaggaatagattgcaaaattaaatcctgcaataccttccatacaacattctgtacaacctaaaggatatggtttacctaaactcatcttactcataaatattcaaattgtttttatacctttagctaacgttgttttctactgatgtcgattctgcaatcacctctgcatttggaaaaacagcactttcctcgttttttacttttttaactaccgctctttttgttaccgtctttttaggcttaacctctgttgcctcagagacagtatcagcgacagtttttttggttctcgtggttttaccctttgctatttttttctctgttttcaccgctgtatcttcaactttcgaggtttttctcatttttctgactttttttactttatgcagtttaagatacactgttgctagaggaggaatatcaatactgatagattgtgctttattatgactttcaatatcttcagttacaattttgctcgtatttgtcgaatttgatcccatatactgttgtgcatcggagtttaaaatttccatatattcaccggcaatatttacaccaaaacggtaattttgacgtaaaacaggggtgaaattactgataacaataatacgttcatcttttttactacgacgctcaaaaacaaacacggaattttgataatcatcaacaacaagccattcaaaaccttgtggatccgtatctaactcaaagagcggtgcatttttttgataaatatgattaagatctctaacataatcctgtatagctttatgccagccaccaccatgaaattcatcaagaagataccaatccaaactttcctgataattccattctctgccttgagcaaattcattgcccataaagagtaattttttacctggataaccccacatataaccataatatgcacgtaaattagcaaatttttgccacgcatctccgggcattttaccgagtaatgaacatttaccatgtacaacttcatcatgtgaaagcggtaaaataaagttctcactatattgatacaccataccaaaggtcatttggttatggtgatgttgacgataaatcggatcttttttcatatacgacaatgtatcgttcatccaacccatattccatttaaaatgaaaacctaaaccaccttcatacggaggatgagtaacaccggcaaaagaggttgattcttccgcaattgatacaacaccaggaatttccgttcccaataaatgattagtttgtttcaaaaattcaatggcctccaaattttcacgaccaccatactgatttggtatccattgcccgtcttcacggctatagtcacgataaatcatagacgcaaccgcatctactcgaataccgtctaagccaaaccgctccatccaatacaacgcattcgaagccaaataattttttacttcatgacgaccgtagttataaatcaaagtattccaatcttgatgataaccttctttgggatccgcatgttcatataaagccgtaccgtcaaaagcaactaaaccgtgcgtatcgcttgggaaatgacctggaacccagtctaaaatcacattgattccagccttatgagctttattcactaaacgtttaaaaccttcggctgtaccaaaacggctagtcggagaatacaaaccaataggctgataaccccacgaaccgtcaaatggaaattcagagattggtaaaagctcaatatgcgtaaatcccatgtcttttacatagggaataagctcatcagcaatttgatcataatccagccaaaaattattttccaagttacgacgccaagaacccaaatgtacttcataaattgaaatcggctgatcagcttgattagcttttcggcgtttttcagtcattgatacaatttcaggcaatgccccaatttgtgaggctgtatcaggacgtaattgtgaactgaaggcataaggatcggcttttaagcgtaattgattatgacagtctaacagctcaaatttatacagttgccccaacgatactttgggtaaaaataattcccaaataccgctagattgatgaaaacgcattgggtgccgacgaccgtcccaatagttaaaatcgcctacgaccgaaacacgtttagcatttggtgcccacagacgaaaatttacacctgctacgttgtcacattcggtaaaatgtgcacctaaaatttcataagggcgtttatgggagccttctgccagtagccaattatcaagttcattaatcatcggatgaaatgcgtaaggatcttctataacttgagcttcatttccccaataaacttctaattgatacgcaaaaaaactatgcgtattaggcacaactccggcaaaaaaaccacgttcatctaccctcgataattcacaaagtacattttttgtttctttactgagaacaaatactttttcagcatccggtaataatacccttacttcaatcccatttgacgtttcatgcatacctaacacggaaaaaggatctgcatgttttccatcaaaaaaagtatcaatggtagattgtgatacaaatttattcataaaaaccctgcctatttatttcttgcctgattaattgttctaattaatgaaagtactgttttatcagtaaaaattttttctagcggttgtaataatttcttacgccagttaggatattccgttgaagtgccgggtacgttaaataaaacctcttgacgaagtaaattttccagttgtacacctattaactgcgtttgactttcagccaaatattgatgaataacatgatttaaattatcgtgcatcgccatatttaacgcatctccccaataattaggcggcaaatattgatctcggtgcaaagtatcaagcaatgcttgtttatctactactcgttgatcatattttgattttaaaatatcttctttcaacatgcctaactgagcaaacagttctaaatcgtgacaatgccaaaaactctgcaatgaaggaagatcatgagttccaactgtagcaaatgcttgcaaaggaaaatgatctgctttcggatattcgttgtgttgttgctcaaaatacagaacaaagtaagagaacactttaaattcatccaatttaaaccgcacttcattaggtacagtacctaaatcctcaccgacaattaaacattgattacgctgactttcaattgccaaaattgccatcaactctgcaaaaggataatgtacataaagtccatcacaggcactttttccttccggtatcaaccataagcggaataatcccataatatgatcaatacgtaacacaccaaaatgctgcatattggatcgcaacatatcaataaaaggttgaaagccacgagcttttaaaattgttggattataaggtgggatattccaattttgtcctaccggtcccaaaggatccggcggagcaccaactgaagcgttcacacaataaagtgttttatcagaccaaacatccgcacttcctctcgaactgcttacagccaaatctccataaattcccaacgacatacccttttccaagcacaaattttttacttcagttaattgggtattagccaaccattgcaaccaagcataaaaatccacctgtgttttatattttcgtaataaattttgacgctcttcatcggttaaaaattgccattctttacgccaacctaaccaaccaattttattttcatcttccggcatattttgatgttcaatgctatctaatacatcaaataaagcctgagataataaagcgttaccttgtgcttgcataaaatcagcaaattgacgacgacgctcaatgattttacttgctctactacgtttaaaataagcgaacaactcatctaatacgaaacgttttaatgacattactgcctgataatctacaacctctgaccgacgtaattcagcaagtttggcttgaatattctctcttctaaaccaattttggacttttttgcataaattaaattcgggtaattgatcgacagccaaatacaaaaaattcaaccaacgtcttgacgaagaactgtacggacttgcccattcaggaatagccggataaagttgatgtaacggattaattccaataaagtcagctcccagcaccgcacttttctcaattaaatatgcaagatcggcaaaatcgccaatcccccaattgcgagcggaaaccaaactataaagctgaacattaattccccatgcttttttacgttgaaatactgtcggttgataagattgttgaggcgaaactaaaatgcgaacgacatagttctttccatttatttcaagaagcaacgaataataaccataagctaaaggagataatgttagttttttctgctctttaagaagttggctccaagacaggaagttcccattatcatcatacaaagaatattgaatagaaatgccggaagataaattaaatgcggttaagtcataaattataggttcattttcactgacgactattacatcatcaaattttttatcttctgaaccgacttccgtttgactcagtaattgaatgaaataatgcagactttccggttttgcgtaaatcaaattaccatcaatatcataatgagatatggcaatccctattttttctgcatcttgttgtaattgattagaaatgcccatcttactctcaaaaagcttaaaaagaattaaatcaatttcattctatctaatcttaactgacaaaagcaaacgcattactttaaattgtgatccagttcaaatagaaattttaagttttttcatcaatcacaaattcaaaccaatcaatcacatctttttcatgaataccctgctcaatcatcacaccagcacatttcatcgcttgagaatgaccaacgatgagaggatgccaatcaaagagcggtttattttcataaagtaaacgataagcacaagtactgggcaaccaactgaaatgtggcaaatttgctttagttaattttgtacaatctttctctaagcgaaaacgtttctcataatgaccgcactttcccgtttctaaattcaatagattgcaagcaatacgagtaaaatacagcttttgtcgttttcctcgcccttcaataaacttacggtaacagcacttgccacaaccatcacaaagtgcttcccattcttcatcgttcatttcaagcaaagatttatatttccagaattcaggggataaagtcatttcaaaaaaaaccgatactatcatcttaaaaaaataatccggttaaatattattcaaccggactcgtagaatattacccaattcagggagtgcggaatttaaccgcacttttattactgtgtcaatattgcttcaaatctaaattgagatggcaaaattttatgggataaagcctctatattttgttgagttacttgctgtaataactgttgctcagcaaacataagcaaaggaccatcactcaaagaataactttgttccaattgagataaaatggctaacaatgattcctttgcctgttttaactgagattgtttttcactcacttttttagccaacaattcaggctcaatgccttgtttaagtatttgatctaatacatgatgagtcatctgcgttaattcctgtacacgcataggatcacaactaaactctattttcccctcaatttgaggtgaaaaatgttcttgttcaaaccacgcatgcactgcatagatacccgatgcctgttctcttaaactcaaccgtaatttctcttgtatgatatccgctaaaatatccagtaaatatttgttttccacttgccattgatgatcagctgcgaaatacatttcaacttctgctcttggctcatgcaagcctttaacaactaaacgctgctcgggtacatgtgcctttatcggctgtaatactctattttgtgttttaaccggtacattggctaaatatttttcagccaaattttgtaccgcactttcgctaatatcaccaacaataaaataagtgaaatctgttttatccgtaatatattgctgataaattgcggaaagtttatctgccgttaaatgcagattactgaaacgatttgcaccatatagcgtttcttgttgtggaaaacgcaattgctctactttctgcataaacgtcttttccggacttttttcattcacttcatcctgtaaagtttggcgatattcggctaagactttatctgaaacagggctggtttgtagttttaacctaaataattgtagaatatccgctaaactttctgttttacctgctgccgtaaaaccctgatcagcctcatcaataaccgtcgtaaaagctatcggagcgtgactgaaatactgatcaatatcagcctgaggtacaatgccaattccagtatcatcgaccacagaaatcgccgctcttaacgcatgataatgtgatcttggcacagaacgtaatcctcctgctgtcaaggctttaaaatagacttgttgcggacttttatcactatacatataaatcaatttactaccgttacttaacaaatattcagtaattttttgtccacgccatactttttgcttagtggcatttccggcaactaaatctaaatgcggaagctgaactaccctattatcttgttgttgccaagaagattgcgattgctgtaaagcctgttgccatttttgtgctaaccactgactatcaaacgataatttgtgcggttttggctgagtaatcagcaccaacttggactttaactgcaacatttgttgaaaagtgcggttaatatctgccaaagtcagttgattgaacaattgatgatttaattcatattggtcttgaggagagagtaacacttgatcatttgccatagtaacgaccaattcgtcagcaattttgatactactcacttccaaatgtcgttgtttagtatttattttacgcaaacgctgaagttcttcatccaattccgtctgcgtaaacccgttttgagcaatttctgcaataaagttaaagagttgctctgtcgctttttgataatcctcattctcaagttgtaaagaaaatgtggattgtaacgtttgcttacctaaataatcatgataaaaattagcagattttacgaccgcacttgaagactgctgtaaatatgtttcccattgttgcaaacgtaaattaagcaaacgcaccacaatttgttgccataaattctctcggtattgtgctaccgtattgatattttctgccggtttaaaaaaactcaagtccaatcccggttcacgcatttctttctcagacacggtcgctaaacgccatttaggcggtaaaggaatatcaaaatcaatctcgggtaaaggttggtgttgtaacggatggctactccctaatttctgttgaattaaagacttaatttttaccggattcacatcacctaccacaataagactgacattatccggacgataccattttcgataaaaatcttttacacgctgtgccgaaacatgtttaatgacgttgacatcaccaatcggatctcgttctacataacgtgaccccgccatttctatttggctttttttatcccctaaacgcaacataggacttaaacgtgatcgccattcttccaacacaattccacgttccgcctctaaatccgctggtaaaatggtaagatggtttagccattgatcaataacattgaatgccaagctaagagattgcggatcatttttagcgatatttaatgtataaaccgtattttcaaaatcggtaaacgcattaatatcacgtgcaaacttcattcctaatttctcaagtgcattaataatttgattttgcggatattgttgcgagccattaaatgccatatgttcaacaatatgggcaacccctttttgatcatcatcttcgtgcatcgaccctgcattaactaccaaacgcatatacacacgattttgcggaaaatgattaggtaaaatgacataacgcaagccattttccagttgtccttgataggcttgcgaatgaaaaggtaacgtatctttttcatgaaataaggattggcaagcaccaatccccaaaagagcggttaaaattagcaatattttttttaacattagaattcataccccaattcaagccaaaattcacgacctgctgcgtagaaaccattatcctcgttagaacttaacccctttctcgtttgattaaggacattcaatatatcaaatttcacaatcgcagaatgtttgccaaagattttaggttgccaacgaaggctggtatcccattgtgtatgggtgccgtaattaaaactgcgataaatcggtaactgactatttctactacctgtatccaattgtttaaacccttttataggtgcttttacataaattcggttggtccattccaaattataatttggcatagacatatccacgccaatccgagccatccattcttcacgattgttattaactttagaccgcatttctaattcggtcatttgttttccgtctaaaatcacaatggaattcgggtcatatcctacacctatatcaatacccttggtatttaaccaatcaaaccccagcgaagctcgccattctgtctgccaaaatttccaactgtctttattttgaatttgcaacgtatatacattattgctgtaatctttgcctcgtgcaaaatgacgcacttttttacccgatggaccatcttcttttagtatgatgcggtttttattttgacgatgaatatatcgggcatcaaggataacattcccgagttcttgattaatactgaaactcaattcatcactaaacggcgttttcatggatgagagggactgataacgttttccaccaccattaccatctatatcatctaatttgaaaataccctcacttaatttcatggaggcaaaagagcggccataataacggtttgctccgagacttaatttagtttgttcaaaaggttgatagcgggcgacaaaacgaggggcaatattggtatttttaaggaaattatcacgctctaaacgtaaccccggacgaaactcccatttaccccccagcttgattaaatcttcgacataaagggcgatattgtgataatcggtttttactgttcctttggaaacggaatttgaagaaagaggactttccatactgtcctgcatgaaaatttcagatttagcattttgatcacgttgaaaacgatagtgcgtaaattgccagataccccctaaggaaatagaatgttcagtacgtccccaagtcaacggatccatagcaaattcactggaaaaatgcacattgcgttgcgttaaagcactatctcccattcctccacgttcataattaatcggatcatagttttcatcaaatgccaatatttgcttcaaataattagaggcggatttacgcttatctgcaaattgatcatacgccaatgtattagttaacacaccgctctttaacgaacgaatccaagctaaagtagcaccataggcttgatgataatcttgcacattgctatcaacattctctgcaaagaatttagtttccacataattagaataacgcaaactcaattcaaagcgattatcctcattagcaagccagttaaaattcaacaacgcattatcggaacggcgtttatgtctgcgattatccgaactcaacttgttatcttttcccagcactaaacgacgttgctgaatatctgaagtacggcgactaaatcctgctaccataccgatattttcccctaaagaatgttgtgcagaaaggctgaagaaatctttgctatatttaggttgaaaatccgcactactaccgttaggcgaggcttgtttaaatttttctcgatctttttcctcaagatggaatttcgcccaattagaatggctggtacgataacgcagttgcacaccatctgtaccgtcatattgcttggttttggcgactacggcaccgccggcaaaaccgcctaaactggcggaaatatcgctgtcgtaaacggttacggaagacaataaattcgcatcaaagaaataggcttgtgcatgacttgccataggcaaagtttgcatcgctccctcaaaaatttcagagtcaaatcctaaatcattattgatattgacattatctacaaaataactggtttgactggcttccgcaccattaatcgaaatgtcagcaggtttaatttcacctcgttgaaaactgttttcatcactacgttcaaaacgcacatgagaattggttttcaaaaaatcagaaatattgccgttggaattaggggaagatttaatatctttggcggttactttttggctggaagataatcctgcgttttgctctgcataaacaacaacctccggtaattgattagctcgttcaactttatttttacttgtttctgcttgagcggaaaacgctaaacagacgctgacagctaataaggtttttttagtttttaaatcataaactgacataaattttccttaattagatataaatgataataattcttataaattttatcatctaaattttttaatgtaaaaatgttcatcgcttgcagaaaaaaaataatccgaccataggtatgatcggattatgtgagaggcattaaaatcattaaatatactcagtaatacaaccgcacttttggcgaaaaggaactgatattaaaacccttctttcagactgacagttagattaaaaactaagttatctgcattactgtctttgctatcggcacaataatacccttcccgttcaaattgatacgcttgttcggctttggcattagcaaggctttgttcaactactccacgcttaatgattaaggaatttggatttaacacttcattaatgtcttccactgctcccggattcgctacggtaaacaatttgtcatacaaacgaaattctgccgataaattatccgttgctgacacccattgaataacaccttttactttgcgtccctcaggatttttacctaatgtttcgggatcataagtacaatatactgtggttacacaaccttccgcatctttttcaacacgttccgctttaatcacgtaagcattacgcaaccgcacttctttacccaacactagacgcttatattgtttattcgcttcttcacggaaatcagcctgatcgatataaatttctttggtaaaaggaagttccctcgttcccaattcttcacgatttgggtgattaggtgcggtaagtatttctttcccatcaaaattttcaatcacaatttttagcgggtttaatactgccattgcacgaggtgcgtttgtgtttaaatcatcacgaatacagctttctaatgcactgtattccaccacgttatcctgtttagttacccctatacgacgacaaaactcacgcaatgatgcaggggtataacctcgacgacgtaaaccggaaatggtaggcatacgtggatcattccaaccgtcaacaatcccatcattaaccaatttcagtagcttacgtttagatgtcaacgtatattctaaattcaaacgtgaaaattcatattgatgcggtaacggacgctcaatcgaaatattatccaatacccaatcatataaacggcggttatcttgaaattctagcgtacataatgaatgagtaattctttcaatggcatcggaaatgcaatgagtaaaatcgtacatcgggtaaatgcaccatttatcacctgtttgatgatgacttgcaaatttgatgcgatataacacaggatcacgcataaccataaaaggagatgccatatcaattttcgctcttaaacttgccgctccttctgcaaactcgccttttttcattttttcaaataacgccaagttttcttctatgctacgatcacgataaggactgtttttacctgctgatgtaagtgttcctctatactcacgaatttgctcaggtgaaagttcatcaacataagccaacccttttttaattaattcaattgcataactatacagttgatcgaaatagtcggaagcatagcgaggctccccctcccattcaaaacctaaccattttacatcttgcttaatactgtcaacgtattccacatcttcttttactggattggtatcgtcaaaacgtaaattacatttaccctgataatcttgtgcaataccgaaatttaaacaaatcgatttagcatgaccaatatgtaaatagccgttcggctcagggggaaaacgagtataaacattatgatgttttccgctagctaaatcttcatcaataatttggcgaataaaatttgttggtttatgttccgtattttccatttcaactgttatttcgctcattttttgtcctcaatgcaatttgataattaaaaatctgcgtattttacagtgttttgcacagaatacaaagtacagcggattttatctcacttggcatatctgtacattaccttttgtaaactttcaggtaaaatagcataacttctaatacaggtatttttataccgcacttatttttcatgaaaaggaacgtttatgtctgatttgaccctacacagccgacatacctatttagatcaagtcaaacacattgtggcaatcggtgggggtcatgggttaggacgtgtcatgtctgcattgagctttatgaatgagcgtcttaccggtattgttactacaacagataatggcggctcaacagggcggattcgacaaactcagggcggcattgcttggggtgatttacgcaattgtcttaatcagatcattacagaacctagtacagcatctgctttatttgaatatcgtttttccggtcaaggtgaattagcagggcataatttaggtaatttaatgctgaaagcactggaaaatatgaatatccgtccaacagttgcggttaatttaattcgagatcttctcaaagtgcggtcttttattgtgccaatgtctgaaagccctgtacaccttgcagcctccttgtctcccggtaaaagtatcgttggagaagtaagtattgatcaattaaccgaaatccctacatctatttttttagttccattagtacaggctaccactgaagcaattcaagctttaaaaaaagcggaagtcattttattcggtccgggtagcttcttaaccagcattatgccgccattattactaccagaaattattgaggtgctgaaaaatagtcaagctaagaaaatccttattgataatttaagtgtagaacacggtcctgccgccaaattatctttaatcgatcgcattcaatggattaatcaaactattggttgtgatattattgatggtgcgatcgttcaaagcaagccgcaacagaattatcacacctcctcaataaaaatcatggctcgccaacttaaagccgatgatataggctaccgccacgaccgcactttactttgtaatgcgattgacgaattattgacagaattagctcatcatttttcacctaagcaagtttgactaatttagctggaattccttgtctaacagcggagccacatacccaatcaacccaaggcgaggcaatctctttggtactatctaacaaaccaagatcattaatattaactccggaaccaatctgagcatttccttcaattaatttcccattaattgtataacctgtggcccccagttgtttatgtccataaccatgttcaatcgcaatcgtccctttaatgacaccgttcatcacaaccagctgcacaacagcttttcctcctggggtatttagctccacaaggtcaccatgctgtaatccatattccgtggcatcctgttgattaattgccacaataccattaggtttaatactatgtaatcttagtaaaggtgctgtaatactactcattaaatttgatttaaaggaaattaatttaaatggccattgtattttagggtaatggctttcaactgtgctattatcggcaaactgatcttcaaaatacgttggacagccgtgataatttttaccggtttgagcatgtttggcttttgctacattttcattccaaatttgcaaacagtttttccagcgagcctgcatattatcttcctgccatgcactgctatgaggagcaaaacgtccgcctttacagtaaattgtagccactttcttaatttcttcaggttttaacacttgttgtaaacttggcatcaaacgttgtacacccgttagcaataaatcttcttgagttgcatcttgtaccggctgttttccatcataagctatattggcagctgctcgtaaaaagaagtcttcactacgatttaaaggataggaatgattttgtttatctaagatagcattatcaccaaatccaggtaattgcatcatcttagcaatttcgataacaaaactttccatacaaatagtatcgccttgagatgttttctcattaggcgatgctatcacaggccagcgggcagtactggtttttgttggaacaccagcccaaggggtactaaatccccaactctcaaaattatgggtatccggcacaatataatcggcaagggcggtagtttcattcataaaagcatcaatagaaataaagagcggtaagattttcggatcttttaatttctgctgcgtaatatggtgaatacctgtcataccataaattggattccccatatgattaatccaagctttaagtgagtatggatagccttgtaaggcagaagtaatcatttctgacatttgtccgccaacaaaaggataccaagcggctttcgctggatatggagaaataccttgtgctactttttgtttaaattcactggatttttcataatcttttttactacgagctaaatttgttcctttgggtttaaccatattggggaaatttgcaagattgtaacgaggtccagcagcaaaatctttaaatttaccgccactcatactcatccccccttttttattcatatttcctatcatggcattaagtaacaatatcgcccatgctgtatagaaaccattgctatgcatagttccaccgtgggtaataactgccgcacgaggtccgtgagaagtaaactttttagcaagttgaataatagtatcaacaggtacaccacactgctcagaatattcctcaatggagtatgaaaaacaagattctttgaataattgtaaagctgatttagctaaaacctgtgagccgtctttaaggcttatcctgtcttccacaaaaagcaccgcactttggcaatctttggcagctataaatttgcctgtttgtcgatctttcaccaaaatatcactatcgctcaatttttcaggttcgggtaaatcctctatatgaaaatttctaatggcttgcccatactgcttatgatttggatcggcgataaataaatgtgttgcattacaaaaacttacgccattagcttgttgcatcgcaatttcacttggtatagacaaataatcttcgttataacgttcattttcaataatccaacgtaacatggctagtgctaaagaaagatctttacccggaataattggtacccagcgatttttatcttgtgctgcagttgaggtaagctctaaacgaggtgctatcacgacatattcaaaattatcctctgtacgcttcttagcaagctgacgagattgacgtttaaatggatttccggattgtgcaggagaagttcccataaacaaaataaattcaacatgatcccaatcaggtttagcatgagaattattagcaaagtcattcataaatgcaccggatccggcacgataggataaaccacaaaaagagccatgagaggcgaagttaatggtaccaaaactgttgtttgcaaaacgtttcagtagaggttgtcttccttcaggacctgcgaaggttaccatcagttgatttacttttgcaccaaaatcagggtgttgtgcattcactggcgtttgcaaatcacgaatcgcttttaatccatctacatgtccttctccaaatagatctccgccattcacaacttcatcaattaattgctcaaaactaatcgttttccatttaccttctccccttttacctactcgcttaagaggttgtgtaatacgataagggctatttatcccatctaaaaatgcagctccacgggcacaagcagtagaacgttgctgtaagccattttcaccagaaacgcttaactctgcttgtttaattgattgattataatcaaggtaatgatctgatgagagcgggtgataaggattaccgttaatacgcaatactttatttttttctaaatctattcgaacccgtaaaccacatagagtccagcaacccatacattgggtattacacactacttgttggctattggttaataaattgccctctttgacttgatattcaggtaataaagaatttccatttatattgtcttgtgttttttgtcctgaggaaccttcaattacgccctttgcaatttcttttactttgggagaataacctgcaacaaaagcagtagcggcagttgtagccaaagctccttttatcaaattacgtctttgtttattcatgatcttttctccccaaatttgattgcaatagtgtatgagatagcagttgccataaaataatacctactaataaccacaagctaaagacagctatcattccaattagcccatctacgttccaactcaattgatatggatttaccaaagcgttatattttgcgatttgctgtacttcaattaataaaatccaacgggtaagccaagtgatacaaagtgcggttaatattcgtaataaccttaggaaagttgaatgaggcaataacagcaatatgaacaaaacgaagatcccaatgagtaataacatcggtgaatagctaatttgccataatttcattaaatgaatagctgtttgctcagaaaataaataaatccccaaaatagaaactattaatcctaataaactggcgatagtaaagtatctgagagcataaacttgaggtataaaataatgacaaaataataagctgacgggtaaaacactaaatacgagcaaaggtaaaagccaagtgtgatgccataaaggacgagcctgtacagtgaagacctccatcgtggtatacattaaaatcaatattgtcataattaaagaaagccaaacaaaaaagactttaattaaatcagtattgaatttcccccaataaagccagtgaaaatacttaggaatagattgcattggaactgaggtacgtaatgaacataaaaaatatcctgccacggataaaacaaagaaaggtaaaaaccatgctccccaatacatccaagaccatatcgttgggttcaaataaaaattcataatacgacccggttgatgtaaatccgcagttaaggcaataggtgcaacaattgcacaactgaacgctaagctaagagcaagcaattcaagacgtgaatttttaataaaatgaaagaagaacgcagtcaaaacagatgaacaggctaatccaataaagaaaaaatagcttaccgcccaaggtagccaagcaatagcttgtggttctactaagatctcacgaataatcattctgctttctccttatcttgccataacattggttgaccgttaacttcattcacaaaagcatcatctaaacctagataaaatacatgtggaatggtaccgtgatccggttttaaaaccttcaaatcatctttaaattcatctaccattttactaattgtactggttggatcccgtaaatccccaataatacgagctcctcccacacaactctctacacaggcaggtaataatcctgcttctaaacgatgagtacaaaaagtgcatttatctgcagttttagtttctgagttgataaaacgagcatcataaggacaagcttgtacacaataagcacaaccaatacagcgtttgttatcaatcacaacaataccgtctttacgctgataagttgcttgtacagggcaaaccggcacacaaggagggttatcacaatggttgcataatcgaggaagtagaacattattggtaatattctgttcattggtgacttcatattgacgtacggtagtgcgaaactcgccaagcggtgtttgattttccaccgaacaactcaccgtacaagattggcaaccgatacaacggcgtaaatcaactaacatggcatagcgatgagcttcattaccctcttttctttccggctgaaaacttgtattcgcttgagaaaaagggataaaagcctgcccaatagttagtactgataagtttttcaaaaaacgtcttttgcttatgtacataatcacccctacctttaataaagattgagcattcaagttgatcaattcaggttgtctgaataccaatgcttaatcttcccactcacaaataaaatatttaataaaattgagttgttacctcttttagcgtattgttaaaaaatctccatgaaaaaaccattgtggttttccacataaaaatatgaggatattgatcttcatcaataaaaggaaataaagtgagaaagtgcggtcagtttttaaaaaattttatgttaataatggctttattgccccagttagcttttgcacaatcttggaaaatcggtattttggcacagcgaggaattgctgaagcacatgagcgttggcaaccttggattgattggctaaatcaacaatttgatgaacataaccaattttcattagttactctcgatcttaatgatctagagacagaacaagcacaaggagttgactttattttaagtaaccaatcccaatttttttatttaaataataaggaagttcgttggttggtaacattaaaatcgctaagacaaaaacaacatgacagcacaggaagagttggtagtgctatttttgttcgtagtgaaagtaatttttatcaattgaaagatttgaagaataaacgtataagtgcggtaggaaataaagcatttggcggatttttattaggttataacgaattatataaccaaggcttgatggaaaataaagatttcaagccggtttttacgggatttccggtagacaatacactactttttttagaggagaaacaggttgatgcagcaattgttcccgtttgtatttttgagcaattggtaaaagagggaaaaataaaagctgaaaatttccgtctattggcagaaaaacctaaccacattggttgtctggcgagtacagtcttactacccaattggtcattagctgcaatgccacaagtacccggtgacttggcatcaaaattaataaccctattgcttaatcaagcgtctgataatcttccgcaatggacacctccatattcaacaaatcaagccgataacatactgcatcagctatataaacacccgaaacaaaatttgtggcaagcaataaaatattggttctcacaatatcaattttggattactggtattattctgcttttattcgttaattatatttggataaattggcagatacatagaaaaagtaaagccttacaacaagcgtatcaacaacatcaaaaatatgaacaacagttgatacaggctgatagactttctattcttggagaaatgagtgcaggtattgctcatgaagttaatcaacctcttactgctattagaatgtatgtggaaggtatgaaatatcaagcagaagaacaaagaactcaaatcatattggataaaatattacaacaagtagatagaagtgcggaaattattcataacttaatgaattgggtaaaaggaaaaagtagcgaagatattgagttaatcaatctcaaacatttactaaaaaaagtgactcaattcatttctctacaacattataataaatttcaaattaatctggtttgtgcaacagatatttatttggaaataaaaaccacaattttagaacaaattctctgtaactgtttattaaatgccttacaagcaaaagcatcaatgatagatattatagtagagaaagagcaaaaagaactaaaaataagaattttggataacggaacaggttttcaacaaatagagttggattttccttttgttcctttccgcacaagtaaaaaacaaggattgggcttgggattagtattatgtcagcgtctaatccaagcgatgaacggtaatataaaactatcaaatagacaggatcaatctggggcagaagtgaccttaatcttacaaataaaaggaaaatagtatgaatattcatctacttgatgatgacttaacaatacttgatgccgctagttttttattggagcaagcaggttatcaagttaaaacttggtctaatagtcagcaatttgtacaacaagctaatatttttgagcctggaattttgttattggatatgaaaatgcctcatttagatggaaaagctgttcatcaatttttacagcaacaaaatagcccttttgctgtaattattatgacaggtcatggcgatatccaaatggcagtacaagaactcaaattaggtgcagtagattttttacaaaaacctatgcaatttagccaattacaatcagccattaaactggcgagaaaaaaaacaatggataattatgaacaatatcaaatcaaacgatgttataagcaacttagcactaaagaattagaagttttatctttattattaaaaggttatattaatcgacaaattgcagaaactctaaatatatccgtcagaacagttgaagtacatcgttcacatattatggaaaaaatgcaagcacaaacagcggcggaattaatctacaagatcactcttattaaaaaggacgaataatattcgccctaccgatctagtttactcaatttataccttcatttgcagtctaattgcatcagcaaccaattagcttttgcacctaacgcttttaactgattttattcaatactttcacattatcaaaccctttctctcgaagatatagagcctgtaacttactcatcacccctcgttcacaataaagaacataatttttactttgatctaattcagcgaaatgtgaagataatttataaaaaggcattaaaataatattctgtcctgagatttccagcggtttatcatcgacttcctccggactgcgaatatctaaaatcacgtcattagccgataaaaccgttatttcatcaacttcagatacttctttttttgtttgttcggcaatttgacgaatatctaaatattgtgcattttgcaccgcactttccagcacggaaaaatcaaaataactttcttcctgttcgattttttcttttacagcttttactgtcggacttttagaaatgacaccgcaaaattcaggcatagatttagcaatgtcctctgtaccaatttcttttgccttagcaataatttgttctttgtcatgcgtaattaacgggcgtaaaactaaactttcagccgcctcatcaattaaacgtaaattagttaatgtttgactagacacttgtcccagtgcttctcccgttacaatggcttgaataccaaaacgctgtgcaactttacttgctgctcgcaccatcatacgttttaacacaacacccatttgtccgttatctactttttctaaaatttccgcaacaacctgttcaaaattaatagcaacaaatcgcactttatgcgaaccgctaaaacgcgtccaaatatgatacgccatttgtttcacgccaatttcatgagttgctccgcctaaattgaaaaagcaataatgtactctcgaaccacgacgaattaacatgtagctggatacaccagaatcaaatccaccggaaataagcgataaaacatcttcttgtgtaccgataggataaccaccaattccctgatgacgagctttaatcaacatcattttgtcattttcaatatcaattctgacggtaacatccggtttgctcaactgcacttttgcacttgcaacggcttgatttaaacctccgccaatataacgttcagcatccaatgaactaaaatcatgttttcctttgcgttttactcgtacacaaaatgttttattctcaatctgagttgctacatcactcaaagtttgctcaaaaatatcgtgcaatgtgacaaaaggtttttcttccacttctaagaaatgatgtattccgggaatacgtccgagtaattcaaccaatagtatccggttttctatattcttcgaccgcacttcgatgtaatcccaatgtttaactactgcaacagtatcatcatatttatttaatacattgcgaatattaccggttagaattttcacgaaacgtttacgtacgctttcgcttttaatcataatttcaggaaaaagtttaataataaatttcataatgagtttacatagctttaatttgatgattttcagcacacgtttcgcatactgaattgccttaagtttcgtgacatattagcattcatgccaaatgatataaattaatttttcatttgctatataattttattcataaaatacagtacaatagacaccctgatttaagatgaagcaaggatgattaatatggcacagacacttgacaaaaatgcaactgatgaactcaactttgaaacaaccctcgctcaacttgagtctgttgttcatgtactggaaaatggcgatcttgctcttgaagacgcattgaaagagtttgagcggggtattcaattggctcaagccggtcaacagcgtttgcaacaagctgaacaacgcattcaaattttattgcaaaaaagtgaaaatgcagaattaagcgattatcaaccaagtgaataaaatagttagtttctaatgtatcaatttgctcaagatctccaagaatccaaacaacgaattaatttttttttagaaaaacaattcgagtgcattgatagttctccatctcctttagctgaggcgatgaaatatggattattgttaggtggaaaacgtattcgcccctttttagtttatgcaacaggaaaaatgctcggagcgaatttaattcaattagattatgcagcagcggctattgaagctattcatgcttactcactcattcatgatgatcttccggctatggataatgattcactccgtcgtggacacccaacttgccatattgcctttgatcatgctaccgctattcttgccggcgatgctttacaaccttttgcttttgagctgttaactcaaacacccgatttgtctgccgaacaaaaattagctttagttcaaactttagccaatgcttccggtgttaaaggtatgtgtttagggcaaagtttagatttaatctcagagaatcaacaaattaatttatccgcacttgaaaagatacaccgcaataaaacaggtgccttgttgtcagctgcagtgaagatggggtttatttgttctccgcactttgcaaatataaaattagaagaacaattaatgcactactcctctgctgtgggtttagcttttcaggtacaagatgatattttagatattgaaggtgaaagtatagtgattggaaaaactgccggatctgatctccttgccgataaaagtacttatccaaaacttataggtttagatggtgcaaaacagaaggcacaagaactttatcatcaagcactacaagaattggatgctttgccctttgacacttcagcattgcatgcactcgctgagtttgtcgtaaatcggcaaagctaagtgcggttaaaataaaaatggaataacaaataatgaataaatatccacttctctctctaattaattcacctgatgatctgcgattattaagtaaagacaaattaccgcaactttgtcaagagttacgtagttatttattggaaagtgtaagccaaagcagtgggcatttagcctcaggtcttggcacggttgaattaactgtagctttacattatgtattcaaaacacctttcgatcagttactttgggatgtagggcatcaagcctatccacataaaatccttaccggccgtcgagataaaatgtcaactattcgtcaaaaaggcggattacatccatttccttggcgtgaagaaagtgaatttgatgtgttaagtgttggacattcatccacatctatcagtgcaggtctcggcattgcgattgctgcacagaaagaaaatctcggacgtaaaacaatttgtgtaatcggtgatggtgcaattactgcaggtatggcatttgaagcattaaatcatgcaggctccgtacatacagatatgttagttattttaaatgataatgaaatgtcaatttcagaaaatgtgggggcattaaataatcatctggctcgcttattaagcggttcaatttattctactttgcgtgaaagcggtaaaaaaattctttcgggacttccgccgattaaagagtttgtcaaaaaaaccgaagaacatgtcaaaggtttcgtttccccagtgggaaccctgtttgaacaactcggttttaattatattggacctattgatgggcataatatccatgaactcatatcgactttaaaaaacatgcaatcattgagcggtccgcaattcttacatatcaaaacgaaaaaagggaaaggctatgctccggcagaaaaagatcctattggctttcatggagtacctaaatttgatcataaattaggggaattacctaaatcctcaacgacaccaacttattcacagatttttggcagttggttatgtgaaattgcagcacaagatgaaaaactgatcggtattacgccagctatgcgtgaaggctccggcatggttgagttttcgcaacaatttccacagcaatattttgatgtggcaatcgcagaacaacatgcggtaacttttgccgccggtttggcaattgcaggctacaaacctgttgtagccatttattcaacgttcttacaacgagcctatgatcaacttattcacgatgttgccattcaaaacctacccgtgctatttgctattgatcgtgccggcatagtaggtgcagatggacagactcatcaaggtgcattcgatttaagttttatgcgttgtattcctaacttggtgattatgacaccaagcaatgaaaatgaatgtcgtcaaatgctctataccggttataaatgtggaaaacctgctgctgtacgttatccacgaggcaatgcaatcggtgttaagttagaaccgcttgcagaactaccattgggtaaatcaaagctgattagacaaggtaaaaatattgctattttaaactttggtactttattgtcagaagcaacaaaagtcgctgaagatcttgatgcaaccgttgttgatatgcgttttgttaaacctttggatactcaacgtattcaagaaattgcacaaactcattctttgattgttaccttagaggagaatgcaattcagggtggagccggaagtgcggtagctgaaactttatatcagcatcaacaaaaagtttctttattgcaattggggctaccggataactttatccctcaaggtacacaaaaagaaatgctggctgagttaaaattaaatgctgaagggatttttgaacaaataaaacaatttttgcaaaaaatttaatatttttatgaactattttttatgttgatagtcttatagatcgctagtgcactgcaattgcagttgtctttttaatgttaaagtttcttatattaagacctccccgctattcaatctttgaatagcggttttttcttttttaacactcaacagctataaaagagcggtgatttttacaggtaatctgtaattagacttgactgataaccttaatgtggtaaaacaacgctttcaagtattttggaaggaatakgaatatgtatgaaggactgcttattgtattggttccaatgttcattggatatttaatcaaaacaaaaaataccgcacttttaacacgcataaatcatattatgatgatattgttatatatgatcttattcgtgatgggattttctctaggtcaattggatgatttagcgaaacaactaccgataattggtatctccgcctttacttttgctttaactattcaaggttgtaacatcgtaggattactaatttacgataagttaaaccctattccattaacccatttagtcaaaaacattccttctcgttggaaattacttctcgatagtgcaaaactttgtgcaatggtgttattaggctttgtgatcggtttatcggtaaaaagttggtttatgttaaaatttggtgcaagcacttatattctaataactttaatttttttcgtcggattacaattgcgtaataatggtatctccttaaaagaagtcttctttaataaacgtggactttatacaggtattatcttcgtttttacttcgttgttaggcggaattctttctgcttatattctcgacttgcctattacacaaggacttgccatttcttcgggatttggttggtattctttatccagcgtaatcattaataatgcttggggacctgtttttagtagcatcgcttttttaaatgatctatcaagagaaataactagcttatttattattcctttattgatgctaaactaccgctctaccgcagtaggtatttctggagcaacatcgctggattgtactcttcctattatccaacgttccggaggaattgaagttgtaccgttagcaattagttttggttttatcactaatattcttccccctattttattggtctttttttcctccatcccaatttagctaaaacgagagtaagacgataaaagtctcactctcgttttataagataaaatcatttttcatataattactcgactgctccgataagttaggaaaataattgttggctatttatatttatattcatcttgatagaataaacgagttaacagtaactttgatatcttatgtggggattagttaatatgatgaataaaaaaaatagttatagttacgaagatttgttagcttctggaagaggtgaattatttggtgaaaaaggacctcagctaccagccccccagtatgttaatgatggatcgtgttgtagaaatgaatgaagaaggagggttgttcaataaaggctatgttgaagctgaattggatattaacccgaatttgtctttctttggttgtcattttatcggtgatccggtcatgcctggctgcttaggtttggacgctatgtggcaattagttggattttatcttggttggataggcggtcaaggaaagggacgtgccttgggtgtaggagaagtaaaatttaccggtcaaattttacctacggctaaaaaagttatttatcgtattaatatgaaacgtgtaatcaatcgtaaattagtcatgggaatggcggatggtgaagttgaagttgacggtaaagtcatttacacagcaactgatttaaaagtaggattatttcaagacacctcaacgttttgattaaataattgctattgtgttaaaaaattgtagtttctacgaattttacatttatagagttatctagtttaaaaaagtgcggttatttttattaaataaccgcacttttcttattacttcacttcaccacaattcaaacaatataagtattgccctttgggatcattaaatttatttaaaatacctaattgctcagtcattttctgcattgatgtagaaaagccgaataaatgggcaatatactgacgaagattatgttctgaatgttgtttagcatttttcatcaactcccccaatagtgacggttctttttccgttagccaaacaacagaaaaatcttttatttcttctgaagatttctgtatcactaattctctagctttttcgactgcatcatcaaaactgcccagttgatctaccagtttatacgtataagcatcaaaacctgaccaaacttgaccttgagcaattttatcaacttgtgtttttgataaattacgcccacggctaacaacatccaaaaattgatcataaccatgctctatttccaattgaataatctcactgctgattttagataacgggctgaaatgtgatttcatcaccacatcagttgtcgcaacaccatcggcattcacaccaattttttgcatagatttttcaaacgttggaaacatggcaaaaataccgatagaccctgtaattgtattagggtcagcaacaatataatctgccgttgaggaaatccaataaccgccggaagccgccattgcccccatcgaaacaacgactggctttcctgatttttgtaaattatctacttcttggcgaataatttctgaagcgaacgcacttccacccggactatttactcgcaatacaaccgcttttatatttggctcatcattcgcctcacgtaataattgtgctatgctatctccgcccacattttgttcatcactttcaccatcgacaatagccccttcaacatttaccacggcaatagcaggttgtgtaggttgtgcaaatcgatttttcaatattgccaaataatcctcaaattcaacaaaatccaacttatcatcagaattaactatccaacgtttaatgattttttctcgttcttgcgttaccgctaattctgttattaaaccacgctttttcgcatattcagtctgatttccgttcagtgcttttaattcgctaaggtatgttttactatccggtaacacctgtgctaatggaatatcacgattttcagccacaatttgctgataacttttccataattggttaagccaacggcttgtattttcacgacttttttctgacattttatcgagcataaacggttctaccgcagatttataagtacctacacgaaaaatatgcggtgtaatttccaatttattaaatagcgatttaaaatacaaattctctgcaaccataccttctatcgccacttcaccttgtggatttaacaaaataacatccgcataacttgccaataaatattgactttgcgtatagttatccgcataagcaatcactggtttcttgctggctttaaaggcttgaatagctttcccaatgtaagttaacgcaggaatatctttcccatcaaaataattgagatcaagaacaagtgcggtaatttttggatcttttttagccgcttgaatggcattaacaacatcaaacgttgagatttttctcggtacatgttgattacctaattccaaaagaagctcttgccatgccgtatcatcgctacgattatctgccaaatagccgtccaaatttaatagcaacgcccctttaaaatgagttaaatctactttattcgacatactcgaattaaccgaaaacactgctacaatcaataaaacgaaaaaaagaaatactatattcattacaacacgacgagcaaaattgagcatttgccagcacaatttgagaaaggtcaacatcactttcatattatcctttactaagttaaaacaaatgtcgtaccttaccacaatttccttttacttcatatcgatcaaggtaaaaatgtgctagaatccaccgcacttttaagatgaaaaacaagatggaactaaaatggatgctctacaacttcttaccactcgtcattcagaaaaaaaattaatttcacctgctccaactcggcaacaacttgaacaaatttttcaagctgcactgcatacaccggatcatggaaaattacacccctatcgttttgttgttatagaaaaggaagggttgaataaatttacagagttactaaaagaagctgttttggaattagatcttggacaagagcggttaaaaaaagccgagaatttatcccaaagagcacctatgatcatcggtgtaattgccaaaataaatcctgatattgaaaaaataccggcatgggaacaaatgattaccgcaggttgtgctgcttacgctatgcaattagccgcaaatgcacaagggtttgataatgtttggatcagcggtccttgggttaaaggttctgctttgcgtcaagcctttgattgtgaaaaaaatgataaaatcattgcattattgatgcttggtacagcagaacaaaaaagtgatcgaggaaatcgagaattgaatttagataagtttgtgcgttatttatagattttatgtagcccaaattttcactgggctaaaatctccccttataattaaaaaataaatataactcatttttttaacaaggttaaaaactcttttctagtttctctgtcgtccaaaaatactccgccaaaagccgatgtcacagtgtaactattggtatctttaattccacggcattttacgcaaaaatgcgtagctttaacataaacggctacatcttccgtttctaaaatggtttggaatgccaacaaaatttgttgcgttagacgttcctgaacttgaggacgttgtgcaaaaaaagcaacaacacgattaattttagataaaccgatcacccatttttgcgggtaataagctactgacactttaccatcaatagttacaaaatgatgttcacaagtactggttaaagtcacatcatcaactagcaccatttcacttactttcatgcggttttcaatattagtaattttagggaaattagcgtaatctaaaccactaaaaatctcatcaataaacatttttgataaacgtgccggtgtttcctccaaactgtcatcagataaatctaaaccaatcagttttataacctcacgcatatgttgttcaataccttgacgacgttgatctttatcttgcataagatcaatcattggtgtttcaattcctttttcaaccaaagcattacgaaccttaatcgcttccggagataaattgctcatgactacttcccgtaaaatcgttatatcctttaaaaatgcctgacattctagcaaataaaagctgaaatctctatttattaggtataacaattactgaatttaaagtaaaatgtgagctgttttttcacattattacaaggatttctatgctatctcttgaacaagctttacagcaaatgctttcgcaattagcaactataaataaaactgaaacgctaacattggaacaagcagtggctcgcatttgtgcagaggatattatttcaccgattaatgtaccgtcttttgataattctgcaatggacggttatgcagtacgtttggcagatttgaaacattcaacaacgctatctatatgcgggaaatctttcgccggtaatccattcaacgagcaatggcaagaaaaaagtgttattcgaattatgaccggagcaatgcttcctgaaggtactgatgccgttgtaatgcaagaaaatgttacaataaacgaagacggcacagttactatcaatgaaatacctaaattgcaccaaaacattcgtcgtttaggagaagatataaaagtgggtgatattgcattaaaaatgggctcaaaattgaccgcactttcactcccgcttttagcctctttaggcatctctcacgtaaaagtttataagaaacccaaagttgctctattttcaacgggcgatgagcttgtatccgttggacagcctttagtacaaggaaaaatttacgatagcaatcgctttacaattcgattaatgctggaaaaatttccttgtgacatcttagattttggtattcttcccgatgatgaacaacttttcgagcaaactttttttaaggctcaaaaacaggctgatttagtgataagtagcggtggagtttctgttggagaggctgactttaccaaagctgtcttagaaaagtgcggtgaaattaatttctggaaaattgcaatgaaaccgggcaagccttttgctttcggtaaattaaataacgcttggttttgcggactgcccggcaatccggtttcagctttagtgacgttctatcaacttgtgcagcccgtaatagcaaaattaagtggctatacacaatggaaaatgccacaacaattaaaagcaatcagtgctacaaaattgaaaaaatctgttggtcggattgattttcagcgtggtttttaccaactcaatacacaagggcaaattgaagtttatcctgtcggacaacaaggttctcatctttttagtgcctttgtgaacagtaactgttttattcgtttggaacaagaacgtggaaatgtcgaagccggtagcatcgttactatagaaccttttagtgatattttaaactaggatctttatgcaaatcgaactctcaacaatagaagaattacgctataaccgtcaaattatcatgaaacaaattgattttgatggtcaagaaaagttaaaaggcacaaaaatgcttattgtcggcttgggaggattgggttgtgctgctgctcagtatcttgcttgcacaggtgtagggcatttaactctccttgattttgatactgtttctctctctaatttacaacgccaagtactgcataatgatgagcgtttaaatatgctgaaagtacaatctgctaaaatcgccctgcaacaactgaatcctcatattgaaattcaatgtattgcagaaaaattgaacgaagaaaaacttgctgaaattgtaccgcactttgatgcagtcttagactgtactgataatgtagaaattcgtaatcagctggatcgctgttgtttggctacaaaaacgcctttagtatcaggtgcggcaattcgtatggaagggcaagtttcggtgtttacttatgaagaaaatacaccaacttaccaacatttaagccgtctattcggtgaaaatacgctaagttgtgtggaagcaggtgttttatctccaatagtcggcattgtaggggcaattcaagccttggaagcaataaaagtgcggttaaatataggcaaaattttatcaggacgtttattgatgattgatggtttaaatatgaagatacgtgaaattaacattccgtctgaataaaaactcaatatccttacaatctctaagataatgctggattgcctaaaacacaggtttatcaatcaactgttttcaaagtagcaaagattcaggtagcacgccatcatctccacgatgtacccgcataccttcaacccgcacacgtcccgtcacacaatcagctatggcttttggtaacaaacggtgttctgcagctaaaactcgtgccgccaatgtttccggtgaatcatcatcggccacaggcacagccgcctgtgcgataatcggtccgcaatccatctctgccgttacaaaatgcaccgtacacccaactacacgacatcctgcttccaatgcccgacgatgcgtatccaacccagtgaatgcgggcaataacgatgggtgaatattaatcagcctcccagcataatgcgtgcaaaattctggcgtaagtatcctcataaagcctgctaaaacaacccaatcaggctgatattcatcgatttttctcatcaaagccgcatcaaaatcgctacgttcaggataatctttgtgactgaccacaccggtagcaataccttgttcttccgcccatgccaaaccagcagcatcagctttattagccaatactgccaccacatttgcaccctcaattcgagcttcaactacagcctgcatattactgccacgccctgaaattagaattacaatgttttgagtgttcatttttttccttcaatttttccttcaatcaacccagccgggattaattgctttgttgagatggcacaaacatcgttttaatcactgcaacttcagattccccctacattttatcaacccgttcgattcgaaaaagattcgaagtacgaacaacaaagatagtgaagaatatggattggggtagcccttaaaaggctatggctctatggctatggctatttgctattctccacccatttaccatcaacaaaataggcactccattttgttgttttaccatttttctctgaggtaacatattgacgtttttctttacgactaaagcgaataattgcctcattaccttcaggatctttaactggcgcatcagctaaatagcgtaatttttctggcaggcgatcttgatattgaaccaattcagccacttttgcaggacgactttctcgtgattttggaaaattatgtgctgacataaacacaccactcgccccatcacgcaatacaaaataagcatccgatttttcacattttaattcaggaaaatgtacaggatcctcttttggcggtgccacttccccacttttcaaaatcttccgagtattatcacaatttgtgcaacccatatatttaccgaaacgccctaattttaagtgcatttcggcaccgcacttatcacattcaactacaggaccttcatagcctttaattttatattcaccttgctcgaccaaatagccatcgcaatttggattattcccacaaatatgcaattttcttgtcgtatcaatcaaataactgtccattgcagtatcacatttcgaacaacgcttacgttccattaaggcttttgtttcagagctttcatctaaaacatttaataattccgcttccggaattaaatttattgtggttttgcaccgctctttgggcggtaaggcataaccggaacagcccaaaaaaacaccggtactggcagtacgaatagccatttggcggttacaagttgggcaacctatatctgttgcaaccaaactatttggtttcattcctccgtccaattcatccaattcagcttgtgttaattgttggctaaaatctttaaaaaattgatttaattcttctttccaatttttcttaccgtctgcaatttggtcaagtatattttccatattagcagtaaaatcataactcattaaatcagcaaacgattgattcaatcgatctgtgacaatttcccccattttttctgcataaaaacggcgattttcaactcgaacatagcccctttcttgaattgtggaaataattgctgcataagtagaaggacgaccaatccctcgtttttccaattctttaactaaggcagcttcactaaaacgtgctggtggtttggtgaaatattgttgaggttcaaccttagttaaacttaatttctctccaactttcactatcggcaactcttgatcttcagggtttctattcgattgaggtaatacttttgtccaaccatcaaagcgtaaaacacgtcctttggactttaactcataatctcctgattgtacggttacggttgtactgtcatatttagcggctggcatttgacaagcaacgaattgtcgccaaatcagatcatataaacgcactgcatctctttccattccctctaaactatctgccaattgtcttacatcagaaggacgaattgcttcatgtgcctcttgtgcattttcgttactggaatagaaattcggtttgtccggtaaataggcttgtccaaattcttgcacaatataattacgcaccatttctaaggcatctttacttaaatttgtgctatctgtacgcatataagtaatgtaacccgcttcatataaacgttgtgctaacatcatcgttttctttacgccaaaacctaattttgtgctggcactttgctgtaaagttgaagtaataaaaggtgcttttggttttgacgtcgttggttttatttcaagatctttgacgaaataatcggaaatttgtaaaaaatctaccgcacttctcgcctgttcgatatttttaggttcaaattttttcccttgaaattgtactacatctaaacgaataggtcgtttttgactgtttttactatcaacagaaatttcccaatattcttgaggttgaaaagccttaatttcacgctcacgctcaacgactaattttactgccacagattgaactcgaccggcagatagacctcgtgccacttttttccaaagtaatggtgataccataaaacctactacacgatctaaaaagcgacgagtctgttgtgcattaacacgatccaaatttaactgttcaggtttctcaaaagcttgtttaatcgcatttttagtaatctcattaaatactactcgactaaaacgactgtcttcgccgccaataacttcgcgtaaatgccaagctatcgcctctccttctctatccaaatcggtagcgagataaatatgatcaactttttttgctaaagatttgagttcagaaaccactttctctttaccgggtaaaatttgatacttagcttcccaattatgataaggatcaatccccattctttttaccaacgcattttgctctttttccgtttttatgcgttgtttttcttccgcacttaatcccttcgttgaaataggtttcgctttttcaccgctactttcacctaccgtaggcagatcacgaatatgccctacactggacttaactacatattgattacccaaatacttattaatagttttcgcttttgccggcgactcaacaattactaaggatttactcatatttttatttacctaattcgctgtatttttgtaaaattgcccgctatattgcttactatcttttgcaaggtcaacagttttttataaaaatgggtataaatgaataaactaaatgcagtttcaatcatctgtaaagttattaaaatatacagaacttttaaagctacaacgtaacaaagcatttaccccatcatgtttacgctaaactaaaagcattgattcattttgttatcagcttatatttgtactaaacgacacgctaaaaataaggtaagttaccttattttccctcacttccccagcgaagaaataaatcttgttctaattcaataccaaattgatcacatacacgattgacgctttggttaataatatcatctaagttactgggtttatggtaaaaagcgggcattagaggggtaatctgtgcacctatttctgccgcctgagtcatcaaacgtaaatgtcctaagtgtaaaggtgtttcacgtacacataataccaacggtttacgttcttttaagcatacatcagcagctcttgtcattaaatcatcggtatagctatgtgcaatacctgacagggtttttattgaacaaggcaaaattaccatgcctaaagtgcggtaagatccggaagaaattgccgcactaatgtcacgaatatcataaactttatcggacaattctcggacttgttgtaccgtaaattgtgtttcaagtgcaatagtctgtttcgccgcttggctaataataaggtgcgtttcaatttccggaagggattttaaaatttgcaacagccgaatagcataaatggcaccagatgcaccggtgatgccaataattaaacagtcttttttaagcttcattgtgcatttcgagattcgtggcatctttttcacgctttttctttgctttgtcattacgtaaatcggcaacttgatccaaatacgctgaggtaatatctccagtaacataaacaccggtaaagacagaacaatcaaaatctttaattgctggattttcttgctgaacagctctagttaaagcatcaagatcttggaatataagtttatccacaccaataagtttagcaatttcatgaacatctcgtccataagcaattaattcatttttagtaggcatatcaataccatacacatttggataacgaatttctggtgctgctgaggcaaaatagatcttatttgctcctgctgctcttgccatatcgacaatctgtttcgaagtcgtccctcgcacaatagagtcgtcaaccaacaacacattcttacctttaaattcagaagagatagtattgagcttacgacgtaccgcacttacacgctgagtttgccccggcataataaaggttcttcccacatagcgatttttcacaaaaccttgtcgataaggtttatttaaaatatgtgcaatttgtaacgcaatatcattggacgtttcaggaatgggaatcacaacatcaatatctaaatctttccactcttttgcaattttttgtcctaagttttctcccatgtgaacacgagccgcataaacggagacaccatcaatataagaatccggacgagcaaaataaacatattcaaagatacaaggtgttaacttaggactttcagcacattgttgtgcatataactgaccatcaaaagtaacataaacggcttctcccggtgctacatcacgaacaaattcaaagtcagcaatatctaacgcgatactttcagaagcaaacatatactctgttttaccgcttacctcatcttcacgttttcctaatactaacggacgaataccatttggatcacgaaatgcaactatgccataaccaatcatcattgcaacacaagcataagcaccacgaatatctttgtgagtagctctaactgcctcaaaaatatcctgcgtagataaagggtgtgttgtttgatccaaatgatgagccaaaatatttaacaaaatttccgaatccgaattggtattgacatgacggcgagcaaaggtaaagagtttttgttttaactcttctgaatttgttaaatttccgttatgcaccaaagttaaaccgtaaggtgaatttacataaaatggttgagcttcagagacactggaacttcctgcagtaggataacgcacatgaccaactcccgcattcccttgtaaacgtagcatgtgaacttgctgaaagacatcacttaccaatccatttgcttttcgtaagcgaaaacgattttcttcatctactgtgataatccctgccgcatcttgcccccgatgttgcaataccgtcaaggcattataaatagactgatttacagggctatggctaacaatacccacaattccgcacatatttcacgttccttatttattcaatgttgaatttattaaatttgaatttgcttgtatttgttcaaaaaaccattccacaataaagccaaagtgcggtattaattttgatgttttccaccaatcactctgtgcaaagtttgtgaaagaatcaataaaaaatagcaatgccgccacgattaatatacctcgtagcaacccaaagcaagcacctaataccctatctgttccggttaaacctgttttatcaactaactgactgataatgtagttaagcattgcaccaacaatcaaagttgctacaaataagattgcaatagcaaccgcattacgaacataaggtgcttctatttgagttaaataagttgctaaatagggataaaaattatttgccaccaaaaaagcaacaatccagctggcaagcgacataacttcacgcacaaaccctcgcaataaactgacaattatagagaataaaattattccgataatcattaaatcaagataattgttcattaggtaacctctaaaatcccatcaatttaagaccgcacttattctagcaaaaaaggaaaacgtttgcgtagtctaaattcacgctttatgcaaatttaatcgaaataaaaaagaagaaatcagaattgtcgtctaaaaatatagatggaaatatcaggaaatgtatcctttcagtttaaaatccatctgtctattcactaaaacactagatgagagatgttgagttagtcgataagccgggttctgtcttggacaatcattcatctaggcgtatatttacacatacgctcaagcaacctacccgaactctgagcgggcaactcattgagttcctatttggtcttgctacgagtggagtttaccatgccataaaatgttaccattcatgcggtgtgctcttaccacaccctttcacccttacctgatctcttacgagccattggcggtctgctctctgttgcactggtcgtaggctcacgcctcccggacgttatccggcactctgccctatgtagcccggactttcctctcgtttacttatgcctctaagtcgtttaaaaacggttaaagatttcaacaaaccagcgattgcctgactaactcgatgcggagtatagcgtaaaattcagataaaatatagagttcacccaaaacttgcggtaaaataaccgcacttttcaatgaggaaatgacgatgaattacttacaaatcgctcgaaattcgttagctgccgagcaaaatgctttagccaaacttagtcaaaatttaaatcaacagtttaatcaggttgttgagcttattttaaattgtgaagggcgattagttgttggcggaatcgggaaatccggacttattggtaaaaaaatggttgctacatttgcctcaacaggaacaccaagtttttttctacatccaacagaggcttttcatggtgatttaggtatgttaaagcctattgacattgtgatgttaatctcttacagcggtgaaagtgacgatgttaataaattgattcccagcttaaaaaattttggcaataaaatcattgcattaacaggtaacctaaattctactttagcaaaacatgccgactatatccttgatattagtgttgagcgtgaagcttgtcccaataatctggctccaacaacttcggctttagtaacgttagctttaggcgacgctcttgcggtttctttaattacagccagaaactttcaaccggctgattttgccaaatttcatccaggcggtagtcttggtcgtcgtttgttatgtagagtgaaagatcaaatgcaagttcgtttaccaaaagtaacagaaaacacaaactttactgattgtttaaccgttatgaatgaaggtcgtatgggggttgctcttgtcatggaaaatgaaaatttaaaaggtattattaccgatggtgatattcgccgtgcattaagtgcaaacggaactaatacacttaacaaaacagccaaagatcttatgacttccaatcctaaaactattaactataatacttatctgtctgaagcggaaaactttatgaaagagaaaaaaattcattcattagtcgttgtagatgatcagaataaagtgataggtttagttgaattttcgagttaatcccatgatgttattaaatgaaaaattacaaaaaattaagctggttattaccgatattgatggtgtactaacagacggcttattgcattatgatgccaacggggaagtaatgaaaagtttccatgtgcgtgatggactgggtatctgtatgttaatcaaaaatggcattcaagttgcagtcttatctggtcgagactcccctatcttacgtaaacgcattgcagacttaggcatcaatttatttttcttaggtaaattagaaaaagagagtgcttgttttgaattaatcaaaaaagcaggtgtaacacccgaagaaactgcgtacattggtgatgatagcgttgatttacccgcattttccgtttgcggattgtcttttgccgtaaatgatgcgatggactatgtgaaagattgtgctgatcatattttgagtttacccggagggaaaggtgcctttcgagaagtgtctgatatgattttaaaagctcaaggaaaagcaagtgtctattccacagcacaaggtattctcaaagcagttaacaagatggtgcaataaaatagataatgaaaataacagtccacatacaaaataagcggactgttacttgtctgtaaaatatctctaaacacaactaaaatccccgcaagcaacgtaaaaaatacttttcacattctacccattcattcattaatttaataaccacattatcgatcaccgcacttacataagctaaaccttacatcataattgcctattcgtattctaaataacaatagttattattaaaaatacccttttaaattaataacttataaaaaaataaaagttgcattccatgaaaaactgattaaaataaaacctgttttattcatcaataaaaaaggaactcgctatgctaaatcaagctattattactaagttaaatgaacaaattaacttagagttttattcatctaatgtatatttacagatgagttcatggtgtgctcataacggctatgaaggtgcagctgcatttttacttcgacatgcagatgaagaaatgcaacatatgcataaattattcacttatgtaagtgaaacaagtggtatgcctctgttaggtaaaattgaagcacccaaaaatgattacaaatctttaaaagaaatttttgaaataatcttagaacacgaaaaatttgtaactagtaaaatcaatgaattagttgaaattacttttgcaaccaaagactattcaacatttaacttcttacaatggtatgttgcggaacaacatgaagaagaaaaattatttaccggcattattgataaattcaatttgatgggcgaagacggtcgttctctttactttatcgatcgtgatttacttactttataatagataggacaaaaatatgttatcagcaaatgttatcaaattattaaatgatcaaatgaatttagaattttattcttctaacctgtatttacaaatgagtgcttggtgtgagcaaaacggttttgacggaacagctaaatttttagccacacatgcagtagaagaaatgcaacatatgcgtaagttattcacttatttgaatgaaacaggtgcttcggcaatcattacggctattgatgaaccgccacatgaatttgattcattaaaacaagtaattgaactaacatacgaacatgaaaaactcattacctgcaaaatcaatgaattagtcggaaaaacctttgaagagaaagattattcagctttcaatttcttacaatggtatgtagcagagcaacatgaagaagagaagttatttagtggtattttagataaaattaatcttcttggtgaagatggtaaatgtttatatctaatagataaagacctaggtgatttgacaagtaaagtataatctatagaaaagcaaatctaatctgacagtccctgtttaaaattatcatatctgtcagattagtttgagcttaagttttttctatctaagtacattttccatcaagtgatgttgctattaatctctcacttaagcacgtttttgtgggattataataaagctctctttttgagttactatgccttttaccaaaatgagtaaaaaaataatcatttgtagaatcatactaatgacagtttaaagatatcacttgatagtaattgacaatattcagtagacagtcctttatctgtgataatttgtgtaaagttattaagttgagttgcacaaaataaggaatattttccatatttactgctatcggcaactaatactttttgtttggcattttgttggagcattctttttaaatgagctttctcttctgtaggtgcggtaacacctttttccaaactccaagaattacaacttacaaaagcaatatcaggattaatgttattcaataaagtcaggctatggttaccgatacaggattggctactattatccactcttcccccagttatggtcaattctatttgtttatattcggaaagtaacaaagcgatatgcagatcagtcgtaatcactcgaagtggcatatgagcgattttttttgcaatgcacaaagttgtagtgcctgcatctaatacaatagagtctcccggagaaatgagagaaacagcatattcggctatccgctctttttcagtaatttgcttaagttgcttttcatttgtagttggttggaatggaataaagtggtttaagcttactcctccgtgtgtacgaattacaacaccttcttcatctaattttattaaatcacggcggatagttgcaggagaagcctcagtaacctttaccagctgttctacggtagcaatattatgactttttagaaatagtaaaatctgctctagacgatttttagacatataaactctcttatttgtaattattttactataaataattttttgaaaataagatagtgaaaattaaagaacctaaaacattattgctttaggttctttagtattatttctccattatgtggcttaaaagtacttcgcttccaaatccaccggatttggtcattacaacgatgtctgaatagttaccttcttcaattaagcataaaggcactcccggtactactgcatataatacgttcatttcagttacattcatttgatccaataatgctgcagccccatctccaccgaatagtataagactatcaaatttttcattatcaaggcagaatttacttaaatcagctaagtgttgagaaatttctttagcggtttcagtaatatttgccgattttgcatttacgacttttgctgggtttgctcgaataatcacattatccttactaaaacgtattagagcgtttaattgtagttttagtgaatgttctgactgtgaatagttcatcaactgcgaaggtgaaggatgaaatacaatcgattttccacctaaagttgaaacatattcatcaacttgaagctggcttgtttcgtggattgatgttactacaattaatgttctacctaatgtaatctctcgctttggtctcggtttattttgaatatttttcaatttctgtgctaatccagctgagccaacaggaataattttatttcctatatggtttataacttttgcaataattgcaagatcttcgtgcgttttagcatcaataacgatctgtttatattcactattttcaatagatgcctgcaaattatcgaccgtatcacacggaattacttgagcatcaggcaataattcttgcatagaggaagacagtacagggcaaataggatctttgcctgaagcagtttcctttacaggaacactattaacatataaatgaccagcttctatcgttctccccatttctggatatgcaggacaaataattgctttaacgtctggatataaactagcccaagcttcaatagcaccttcaatttgatattttacagagcctctcattgtagaatcaattttgaggtaaatttgcccaataccattttggatagcattactaattgcaatttgagtttgttcttttgccttttctccaatagctcttgagtcagtagaaacagaaattacttgagctttatcagattgcatttgtgctaatgccgaaactttagtttttaagacagtgttaaaccctgcttcagcaaacataactgcggtatcatttgcaccggtaagatcatctgcaataactaagagagtttctttcatagcttttccccttttactgtttcttgtgctaatccaccttgacgttttaaaacccaagccgcaaataatggagctaaaacagcggaaactaatacagcagctgcaatttgtgcagtagcagtttgcacaaaaggtgctagtgtaggatctgcttgagcaacaatttcaggtgtaattatggcatttccagcagtagtaccagcagcaaatccaatccctgattgattacctcgtcttaaaatagttttgtaaccgataaacacaaggaaacctgtaaagagagaagctactatacctaaaataatacctgttgctccaccagtaataatggcttgtaagttaatacctgtacctaatgcgaaagcaaagaaagggataacaatagcaccagttggtttcattagttctgtccatttaggatctaagttaccaataaccataccaacaatcagaggaataacagctgcaagcatcaatgagaaaagaatatcagctaatcccgatacacctaaaaatagtaaaacaaagaaaggaccgtcattaactgcagaagcaatataagcccctttatctctataatcgccatattttcctgtaaatgccaaccaaatacccccatttgagttagccacaacagtaagcatagctaataaagaaacacccataacaccatcatttcccacccataatcctaaaaaaacaactaaaagagcgggtataattgttttaaataataatacaatgccggtatgagcaagaacaggaccggaacttctcacagtaatttgcataccagttgcgaaaattaagagtgcaataagtgggccagctgatgatttgaataaagctgtcgtaaatgaacctaaattcaaacagtcaggcaaaaacgtaccaataatagaaccaaaaattagtggtattaccattgccccaccgggaattttattcataccatcatatattggaacgatggatttagatacttgagtagacatattaatctccttagtgtgttgcatatttgatgtttgccatttttgcccccaaatagagtgcttcagtcatactacggctatcggcaactccctttcctgcaatcggaaaagcagtaccatggtcgacagatgttcgaataaatggaagaccgacagtaacatttacacctgtatcaaaacctaataatttgatagggatatgtccttgatcgtggtacatcacgacgacaatatcgaactcgtttagattagctgcacgatgaaataaagtatccggtggtacaggtcctgtaacattaaatcctttagcttgagctgctagaattgcaggtacgatttctttttgatcttcatcaccaaacattccattttcaccagaatgagggtttaaaccagcaacagcaatacgaggctctttaaaaccaagaatacgagcattttcttctgccaaatcaataacagtggcaactcgttctttagtaactaaatcacaagctttacgaagttggacgtgagtagtaacgtgaataacgttgagtttttcgctggttagcatcattgagtaatctttagtattactaagggtagctaaaatttcagtatgaccgggaaacattttactacttgcatgtaatgcctctttatttaaaggggctgtaacaatagcttggattttcccttccattgctaacttaacggctttttcgatgtattcataagccgctttaccagcacgaggatcaatttgagcaaaaggcaaatcttctggtaggttattcaaatctaaaatatcaataacaccatactctgccgtaaagctatctagatcatttagtattcttaatttcagttctgaatgaacaataggtaaagctcgttgcataatttttcgatcgccgataacaactgggtgtgctaactcataaatccgtttatcagccaatgctttaataataacttctgggccgatacctgcggcatctcccatcgtaattcctaaaataggtttcattttcactccttgattgaaattaatcaattttagcaaattatatcgcaaataaagagataaaaatgtgattaaagtcaaaaaatgatcttttttaatcatatagattttatttaatctaatggtaaggattataaagcagattagaaaagtaaaatgttatttaatttgaataaacacttccctttttagcaaaaaacggtatcattacgcctcttaaatgtaaccctacatttaagtttgtttccaacctatcctatcttgggacaaatagggtaaaaacaaaaaagctggaacgctttttttaataagtagcgagtcaaatgccccatggcgtctagtctctcgggatttgagagcttaggcttcctccgcaaggcacccgacttatttttttcacctcttttagaaggtttatttcaatgacaattaaaacccctgttcaagcaactcttgcttcaaatcaatactttttagatcgccaagatataatggaatcaaacgtgcgtagttacccgcgtaaactgccgtttgcttatcaaaaagcacagggcgtttgggtaactgatgttgaaggtaatgaatacctcgatttcttagctggtgcaggaacgcttgcattaggtcataatcaccctaaattaattcaagcaattaaagatgttttagacagcggtttgccgttacattctttagatattaccaccccattaaaagatgcttttaccgaagaattactctctttcttccctaaggataaatacatcttacaatttaccggtccatcaggagcagatgctaatgaagcggcaataaaattagcgaaaacctatacaggtcgtggcaatgtcattgcattctctggaggtttccatggtatgacacacggtgcattatctttaaccggtaacttaggtgcaaaaaatgctgtgcaaggtttaatgcctggtgtgcaattcatgccttatccacacgaataccgttgcccatttggtattggcggtgaggctggtgtgaaagcggttgaacattattttgaaaactttattgaagatgttgaaagtggtgtagtaaaaccagcggcggtgattttggaagctattcaaggtgagggcggtgttgttccggctccaatcagcttcttacaaaaagtacgtgaagtaacccaaaaacacggcattttaatgattgtggatgaagtacaagctggtttctgtcgttcaggaaaaatgtttgcctttgaacatgcaaatattgaaccagacattgtagtaatgtcaaaagcaattggtggtagccttcctttagcagttttagctatcaaaaaagaatttgatgcatggcaaccggcaggacatacaggcacattccgtggcaaccaattagcgatggcaacaggctatgtttctctcaaaattatgcgtgaagaaaacttggctcagaacgcaaaagagcggggtgaatacttaactaaagccttaactgaattaagcaaagagtttccttgtatcgggaatgtgcgaggtaaggggttaatgatgggtattgacattgtggacgaacaccaagccaaagatgcaacaggtgcttacccacgtgattgcgatttagcggtagctattcaaaaatattgttttaaaaacaaattgttactagagcgtggtggtcgtggtggaaatgtggtacgtattttatgtgcggtaaacattacccaagcagaatgcgaggaatttattaaacgctttaagcaatctgtaggcgaagctgtgaaagcggtacgtggttaatttttgataaaacaagcggtcatattttgcaaaaaatttgcgaattttgaccgcttgaattgtatatagcattgaatgagataacaaaaatgacagatatttccaaacacagacaatcgctattttgtagcgatccacaatctattgcggattatgaaaccgcaatgaacaatgcggtacaagcggtatcaaattggctaaaaaatgaaaaaatgtacaccggcggttcgatcaagcaaatgcgagccttgattgacggcttcaagccgaccaaagagggcgtgggagtgcaaaaatctcttgagcatttggtagagattttcctcaacccaagccttaaagttcaccatccacactctttagctcacttacattgcccgacaatggtgaccagccaaattgcagaagtgttaattaatgcgactaaccaatctatggactcttgggatcaaagccctgcgggatctattatggaagagcatttaatcgactggttacgccaaaaagtcggctatggtgaaggtacagctggggtgtttacttcaggtggtacgcagtcgaatttaatgggcgtattgttagctcgtgactgggcgattgcgaaccgttggaaaaatgaagacggctctgaatggtcggtgcaagcgaatggtattcctgctgaggcaatgaaaaacgtgaaagtgatttgctcggaaaatgcccacttttcggtacaaaaaaatatggcgatgatgggaatgggcttccaatcggtagtcactgtgccgtcaaatgccaatgctcaaatggacttagaagcgttagccaaaaccttagcagacttaaaagctgatggtaaaatcgtagcttgtattgtagcaactgcaggcacaaccgatgctggtgcgattgatgatttaaaagcaatccgcaaattggcggacgaataccaagcgtggttacacgttgatgctgcttggggaggtgctttattattatcgaaagatttccgtcatttcttagatggaattgaactaaccgactcgattacacttgacttccacaaacatttcttccaatccatttcttgtggggcattcttgttaaaagacgaggtgaattatcgtttcattgattacaaggcagattacctcaactcagaatatgacgaagaacatggtgtaccaaacttagtagcaaaatcactgcaaacaactcgccgttttgatgcgttaaaattatggtttacggtagaagctttgggtgaaaatctgtatgcttcaatgattgatcacggtgtgtatttatcaaaagaggttgaggcttacattactgctaccgaaggcttggaaatgttagtacctgcacaatttgcctcagtgctgttccgtgttgtgccgaaaggctatccggcagaatttgtggatacattgaaccaaaacgtggctgatgagctgtttgctcgtggtgaagcgaatattggtgtcacgaaagtcggtaacaagcaatcactgaaaatgacaaccttaagcccgattgctactcttgaaaatgtgaaagccttattagcacaagtgttggcagaatcagaacgcatcaaagattctattgtaaacggcacctatatcccgcctattgattaaacgattggcaaaattatacctaaatcagaccgcttatcagccttgaattgattaatgagcggtcaattttttaactttttacaaattttattgaaagctctattgttcataacaagttaatcaaccattaatttcctcaatacttcacccaacccactttgacgctcagtcgctttactcaccgccatattccatactttgcggtcagaaaaaacagtaacttgattgattgctcttgttactcctgtataaaccaattctttacataaaacaggattggcttcacaaggcaaaaccacaaaggtatgagaaaattctgaaccttgggatttatgaatagtcatggcaaatgccggactatgatcaggaatacgacttgctaattcagccttaccattttcaaaccaaaaatgcccttttaagctaccatcaggttgtttttctgctaaatacaacgcaatatcaccattagccaatccgagacggctattattttcagtaataatgattggttttccaatatagaaatcacgactatgattaaattgcacaagtccttttttctttaattgttctgcaataagttgattgagattttcgctccccaattctcctaccctaagtgcggtcaaaaatctcactttattgaatgcggcaaaaatagccgcaatatgcagtttaatcggtaagttattttcagtaattttgtgaataagttgcaaatattcttcataattttgcaccgcactttgcacgaccaattgactgcaatattgagaataatggtgtgctaatggctgttcatcaatattagtttgttcatattgtgtagaataatccactaaattgatttctcccgtgtcgtttgtgttattttcttgttgatattgatgaaataattgccaactttcagcaattttttgttggttaattaattgagctaatttaccaatataaggatgtttaccgaaacgacgactgccctctaagttgcataaacaatcacgaataagattttcatctgcatgatgttctaagttttcccctgttgtttgctgtaaataacttgctaacgttgaactaattgaatattgtctaaaagtacctaattcagccaaaatcgctcctgcttcaacagaagataactgatccttatcgccaagcaaaatcagcttacaactcggtttcaaggcttgtaataatttcgccattagaaacaaatccaccatagatgcttcatccactaccaagagatctatcggtagtggattacgtttattatatttcgtcttttcttcaaaaaatcgcacaccaattaaactatgaatagtttcagcattaaaaggaatagcattttttatatgttcactaactttaattaactccttttttgtcaataaattaaaggaatttttcatactaatttttaagcgttctgaagcttttccagttggggcaactaggcgaataactaattttccctctgccaactcctgtaatgccaataataatcgagtaactgttgtcgttttacctgttccaggtccacctgtaatcatgcaaaaaggttgatgaattgccgttgctacagcaattttctgccaattatgcttttgttttaaactattatcttcatgatctaccgggaagtatttttgtaagatgccttgaattttttctatcggatatggttgattttctttctgttttattgttcgaattaaaaattcggcaattcgatgctcatcttgccatgtgcgataaaaatataggcgattattttgtagcaccaagggctttacctcattaataggatcttgagtaaatgcgatatgattaatgagtaaattttgccattcagattgtgtaatattccctattttctctcttatatcaataaggtaacttttttccgcataaggtaaattaaacagatttctaaaagaaaaattttctaattttaagcacgtatgtccttgttgattatgaaaattacaaagtgcggcaagtaaaatagctaaatttttaacttgtgatgaataatctaattcccgttgtttatctgcaatcaactttgcaaaataataatcaccagcttgaataaatttcctttccttaagttgatacaaaatatttagcattaaaataaactctccaattcagaaatcaaacgccaatccggtttatcaaaaaatatcccggaattatcttttccattcattccacgtaaaaaagtataaagtacaccgccgaaatcacgttggtaatcataatttttatcccgctcttttaaataacgatgtaatgcaatggtataaattaaatactgccaatcataatgattattacacatcacttgaattagattgtcttgctgataatgttgagaagaatagcctagtaaattagacttataatctaataagtaatacttgccttcaaaacgaacgaccaaatcaataaaacctctcaccatacctttaattctatccatcagtatcggtgatgacggtaaacgatgatacttacttaacagccgattaaagacattttcattaaatgattgatttaatttcaaataaaattgcatttcttttaaacaatcttgtggcttgatattgcctaaagtaaagcctgcaatatcctgttttaaaggcgtattaaaaatcgcatttatccattttttcaatggattttgccattcatcacttaattgtaacgcctgacaaagtttagataattggtcatcattcaatgcctgcgtcatattatatttttcaaaataacgatggaattcgctaccaacatggacaccatgaggaaaatcaaacggtgaaaaacctacaggataatcagaatctgcactcaactttatatcaaatgactctgacatatcatgaccattttctctcacatcatgatctcttgcttgatcaaaaactccggatatttcaatctgctgtgctttttgtcgagaatttaaagatctgttacgttgatgacggtaggtcatttcagtaaaacttgttacagtccaattacgctcaatcttgccatgaaattcttccgcttcaactagcgacaatgcctgttgcactgtaatatactcatttctccttactaataattttttatcttcctctatttcaatacattgttcgcctaattcctcaattattggacttaacaatttttttgcatcatatgcatcattaattcttttatttacaccaatttgtcccttagttaatacataaagtaacgcattccattttttctcaaaaacgcgaggaagattaataacaatctgatatttcgctcgagtaagtgcaacatagagtaaacggatatcttccgccatacgctctttttcaatttcatcggaatgttgcttatccatatcccataacacttgttcttgattttcatcataataagtattaatggcattatctcggaatagggacggcttacaaataaaaggaatccaaactaaatcataagcaagccctttggatttatgtaatgtaacaatcttgactaattctcgatcactttctaaccgaatttgttcttccaagcgttcttcgccttgaatctgtttctcaaaccaacgaactaaggaggactcggtatcatttaaacgggtagcctgttgcaataactcacttaaatgccacaaatcagtcatttttctctcaccttgttccatcatttgtaaattttcattaattttttcaactgcaaataaatgatgcaacataggtaaaataccctgcctttgccattgttgttggtaagcaataaatcgctcaacacagttttcccataagttctcatcttgcttaatttggaatatttctgcaccggttttagcaaaaagagcggtactcaacgcatttaaaatattattttcatttaacggatttaaacaagctcgtaaaatatgcaacagttcttttgcagtgatactatcaaaaacgttactacgatctgaaagataaactgatgcaatacctttatcccttaaggctttttgtattttctccgcttgagtaaaactactgactaaaactgcaatattttttgcttttagtggtttgttatctaaaatagcttgattttgtaccgcactttgtagccattgctcaatagataaagcacaattttcagcaagttgtgtgtcattgttgtcagtcaaataacctcttaatgcaggttcaattctcccatttaagcaaaatcggttgggaagaagatttccttgagtgtcataatataatcctttagcaacctgttgaaatggaatttttttatgtaaaaaaggagaattttcttgaaaatcaaaaagataatttatcgtctgaataagaggttgtgtagaacgccaattttcgcccaaactaaatcgatattgtgcttgttccgttgctttcagataggtaaaaatatccgcaccacgaaatttataaatagattgtttaggatccccaatcataataaagcccgtatttttcaccgcacttttaatataaatttgataaaaaatatcatattgctgttgatctgtatcctgaaactcatcaatcatagcaaaaggatattgatggcgaataagttgtgctaatttatctccttgtggttgatataaagcattgcgtaccagacgtaaaagatcatcaaaccccttttgttgatgcgtaagtttataatccattattttacgatttaattcatgaacacaatggtataaaagtacagaaaaattatttgaaatttgagtaacttcattggtcactaagttttccaattcggaaaataaatcatgcgatactaaaggttcttttttatctaattccaattgataaaaatattttgccgcctcaggttgctgaatatcctcgttttctgcccatactcgcattttattaaaacgactttcaaaccaatctttacgccatttttttaaagcgacaagctctcttaacgctttttcattttctaaccaacgttgtttaaattgatgaattttactaagttgaggctcaacttgagtatgtaaaaattgctgcagagaaatctccaataagtgcggtttttgggtatttacttttggcggctgagaaagatatttataaacgtaagataccagttgcttcggcgatcctaattttttgaaaatgaagtttgcgactgacaaaggctgatgataaaaattttcacgccatagctcatttgccaaacgttgaattagttcagattcatcactcaccagttccatattaaaatgtacccccgaattaaaggcatattgcattaatactcggcgacaaaaactatgaatagtcgaaacggcggaaatatccaaatttcgctctgctaaagttaaacgatagactgcaagatcgatgtctttaatataaggcagtaattcttgcagaaattgatcttcaagtaatgttttattttgatgttgctgatattgaattaacgcttgttttgtttgataaatacgttcccgaatacgttgctttaactcttgtgttgccatttctgtataagttactaccaaaatttgatcaacttccaatgcctgagaaaaattattttctcccgcttgtaataacaagcgaatataaagagaaacgatggaatgagtttttcctgtaccggcagatgcctcaattaaactgaccgcacttaacggagtagaaataggattaaaaggttgaaagacggatatgcgtaaggaagaatattgatcttgtaagctggtcatgaaattaagcatcttcgatagaacatagaatattgactaatttacctaacctaaactctttttgcaaaccttcaaaccgatgtaaaaataaaacggagcagatcttccgctccgttctcatgttatttgccattcaaactatctaaattacgtaatgcttcaatacgtttttccaatggaggatgacttaagaataaagaagcaagtcctccacgttttccattgatggcaaaagcggctagctgcccctccatttcttgtggctcatgcaacgttttcaaacgttgtaacgctgcaatcattttatgtttacccactaattccgctgaacctgcatcagctttaaattcacgatagcgagaaaaccacattgcaatcatacttgccaatacaccaaacacaagctcaagaaccattgaaatcataaaatatataccttgactggtatttccatcacgatctgtagcaacaacttttgccagcattcgagaaataaaaatgacgaacgtatttaatacgccttgcaacaaagtcatcgttaccatatcaccgcttttaatatggcttacttcgtgagctaaaaccgcttccgcctcatctcttgtcatagcatttagtaatcctgtactcacggcaacaagtgaattcttttttgtcgcacctgttgcaaaagcatttacatccgctgaatgataaatggcaactgtcggcataggtaatcctgctctttctgcctgtgaatgcaccgtttgaagcaaccaatgttccgtttcattacgaggttgttcaataacttgaccatttaccgaacgtaatgccattgattttgacatcagtaaagaaataaccgatcccgtaaaaccaaataaagtagcaaaaatcaacaatcccaccgcatcttggcgttgaataccggtcaacgtcaaaataatgttaaaaacaaataaaacggcaaagttagttgctaaaaatagcaaaattctcatcataataaagttcctttacattaaaaattctctgcctatgataaggacaaaatattgaaactcaagggtaaaataaaaaaatttgttaccataaactcatttgtttttgctcaattattgtgggaatactgacatataatccaactaaacgcacagaacgattttgatgtcgttgccaaatttgagttaatagttttacaaaattttcttgcgaacatttcaccgcacttttttctaatgttgttatttggaagtcataaaattttaatttcacgcctattttacaaaaacgttctaagggaatagcaggacaagtctttttaattcgtttcaataaaagaggataaaggctattgataacctcaataccttgttcaacttgcaaaatatttttcattaaagttcgttccagcccgatagatttaggttcacgatgagactgcacagggcgttcatctataccttgactaaattgccaaatacgatgtcctattttaccaaatcgatcgattaaaacatgatagtcaaattgttgaatatccgaacaagtttctaatcccatttgctgtaatcgttgcgttgtcacttttccaactcccggaatttttttcagtggaagttgcctaataaacgttgcaacttcttcaggcttaataacaaactgtccattgggcttattctgatctgaagcaattttagccaaaaattttaacggagcaataccggcagatgccgttaatcccgtttcctgagtaatgatttgtctaatttcttctgcaatccacgttgctgagcctgaacatttttgacaatccgttacatccaaataagcctcatctaaagacaaaggttcaattaaatccgtataacgcaaaaaaatgtgttggatttgttgcgaaacctgcttatataaaggcatatttacagctaataataccaaatcgggacaaagtttcagtgcttgcgatgttggcattgcactatgtaagccaaactgacgagcaacataattacaagtacttaataccccacgctgattagccaatccgcccacagcaacaggtctatcatacaattccggtttatctcttatttcaatagatgcataaaagcaatccatatcaatatgaataattttacgaaacatcattgttaaaagtgcgattaaaatgttcaaatttgaccgtattctaacatttttactgtataaataaacagtttttgttgtttttcttatttaacatcatttatacctatttttctccaagtaatgtcttttagttatgtttttttgaaagctgtacattttatcctccttttttccgatacggtcctaccagctaaaatttttgacaaaatcactgatttttttgcaaaaaaggcatagaatacaggacgcatttgcaccttaataaaaatgttattaaaatgcggtgttattttgtgctaaaccatttttaggaaaatcagatgagccaagaatttttggattttgaactgcctatcgctgaattagaagcgaaaattgaggctttacgttcagtttcacaacaagatcaacagattaatttagatgatgaaattactcgtttacaaaagaaaagtgcggagctaacgcaaaaaacttttgctaatttagatgcttggcaggtatctcaaatggctcgccaccctaatcgtccttatactttagactatattgaacatatttttacagattttcaaacactggcaggcgatcgtgcttttgctgatgatcaagcaattgtcggtggattggctcgtctagaggaacgtcccgttatgattatcggtcatcaaaaaggacgtagcattaaagaaaaagtaaaacgtaactttggtatgcccgcacctgaaggttatcgcaaagcattacgtttaatgcaaatggcggaacgattcaagttgccaatcattactttcatcgacacgccgggggcttatccgggggtcggtgcagaagaaagaggtcaatctgaagctattgcacgtaatttacgtgaaatgtctatgttaaaagtaccgatcatttgtacagtaattggtgagggcggctcgggaggtgcgcttgctatcggtgttggtgataaaatcaatatgctgcaatacagtacttactccgttatttctccggaaggctgtgcctcgattttatggaaaagtgcagcaaaagcctctacagcagcagaagtaatgggcttaacagcttctcgtttgcacgaattaaaactgattgatagcataattgaagaacccttaggaggtgcacatcgcaactatgacactatgtcaaataatctgaaaaaacgtttgttagccgatcttgccgacttggataaattagatcaagagactttattagatcgccgttacaaacgattaatgagctatggttattgctaattttataaaaatagggcggtcttataccgctcttttctatttatagatatgttatataggaagaaaaaatgaaaaatattctctcaattcaatctcacgttgtttatggctatgcaggcaataaatcagcaacatttccgatgcagttgctaggcattgatgtttgggcgttaaatacagtgcaattttctaaccatacacaatatggaaaatggaccggcatggtcattcccaaagaacaaattggtgaaattgtacaaggtattgataatattggagaacttcatcaatgtgatgctgtcctgtccggttatatcggctcagcagaacaagtagaagaaattataaaagcctttcataaagtaaaagaacgtaatccaaaagcaatttatttgtgcgatccggtgatgggacatcctgataaaggctgtgttgttgcagatggtgttaaagaaggactgattaaaattgcgatggctcaggcagatattattaccccaaatttagttgaactaagagaattaagcggattagcggttgaaaattttgaacaggctattgaagcagtaaaagtgattctaagtaaaggtccgaaaaaagtattggttaaacatttaagtcgtgttggtaagaatgctgcacaatttgaaatgttattggcaaataatgatggtatttggcatatcagtcgcccattacataatttcaataaagaacctgttggcgtaggtgatttaaccgccggattattccttgcaaacctactgaatggaaaatcggatattgaagcatttgaacatactgcaaatacagtaaatgacgtaatggaaacaacacataatgcaggcgtctatgaacttcaaactattgctgctcgtgaatggattgttaatccgaaaagccaatataaagcagtaaaaataggttaatcttattaaattgtaggggttattactcctacttttaatatttccaagctcaatagatttcgatcggaatccctatggatttattacaacagttacaaaatcagttaaatcagtttccctctcatactaaacttctactaggatttagtggcggactggactcaacggttttgttatctttattggcaaaactcagaaaaaaacaaccgcacttatccttacgggcaatccatattcatcacggattaagtcaaaatgcagataactgggctattcattgccgacaaatttgtcagcaactggatatttcttttctgtgtgaaaaggtgacaattaatcctcgtaaaggaattgaggctgatgctcgtgaagcccgttatcaagcgattgctaatcatctacaagacaacgaaattcttgttaccgctcatcatcaacaagatcaaacagaaacctttttgttagctttaaaacgtggcagtggcttacagggattgggggcaatgcaaatacagagtgttgtttttaatctgcctatttttcgcccgcttttacattgcacaagacaacaacttgagcaatatgctaaaacagaaaaacttagctggattgaagatgaaagtaatgctgataatcgttatgaacgtaactttttacgtaacgatattttgcctaaacttcgtcagcgttggcaatctattgataatgcggtacaacgtagtgctcaacattgctttgaacagcagcaactgattaatgaattgcttaatgatgaatttaataaaatttacgataaattcgaccgcactttatccattgccaatttcgctacttactcaattttaaagcaaaaagccttactacgaacttggttacaacatctccatattttgatgccttcaacaatacagttggataatattatgagaaatatgattcaagcacaagaggatcgtaatccgacatgtagacttggaaatcaggtcttacgccgttatcaaaaacgtctttatgctacgccgatattacaagatttaagtcatattcgcctagatattcaagctaacgaatgcattaatttaccggataatttaggtgaaatttgtttactaaccaaaaatgagcatttgcaggttacatggcaaaataaacagattttattacccctgacacaggaaaaaatagaaattcgctttcgctattccggtaaagttaaactcccgcaaggatttcatcaagaaatgaaaaaatgttggcaagatcataatgttcccatatggcaacgcactcgtattcccttgattttttatggcaataaatttaaaagtgcggtaggtttttttaataattgtgagtaaaaaaataaccccatcttgatggggctattttaagaaccaatcctatcttaacgccaacttttaaactgattaattaaaccattagttgaactgtcgtgactattgatttgctcatctccaaccagttctggcaaaatgcggttagcaagttgtttacctaattcaactccccattgatcaaaactgtaaatattaaaaattaccccttgtacaaaaattttatgttcgtacatagcaattaatgcacctaacgtgaatggcgtaattttttgcactaaaatgctgtttgtcggtttattaccggtaaaaattttaaacggtacaatatttttcacttcatctaaggactttcctgcttgaataaattcagcttcaacttcttgttgtgttttaccaaaagcgagtgcttctgtttgtgcaaagaaatttgaaagcaatttattatgatgatctgacaacacattatgggtttgtgctggggcaataaaatcacaaggaataatcttcgtcccttgatgaattaattgatagaatgcgtgctgaccgttagtgccaggttctccccaaataataggaccagtttgataattattaatcacttgaccactgcgatctacatatttaccgttagattccatattaccctgttggaaataagctgcaaaacgatgtaaatattggtcataaggtaacatcgcttcagtttcagcacctaagaaattacagttccaaataccaattaacgctaacgtaatcggaatattttgttccattggtgcggtgcggaaatgtttatccatttcatgtgcaccagctaatagttgctcaaaattgtcaaacccaatagaaagtgcaatagaaagtccgattgcagaccataaagaataacgaccgcctacccaatcccaaaattcaaacatattgtgagtatctataccaaacttctccacttcttttacattggttgaaagtgcagcgaaatgcttagctacttggctttcatcttgtgcggctgctaaaaaccatttacgtgcagaaatcgcattagtcatagtttcctgtgttgtgaaagtttttgaagcaactaaaaataaggttgtttccggatttacttttttcaacgtctccgctatatgcgttccatcaacattggaaacaaagtgcatggttaaatgatttttatagggacgtaatgcttccgttaccatataagggcctaaatccgagccgccgataccgatattcaccacatcggtaatcgctttaccggtgtaacctttccaatcaccggaaataacacgttgacaaaaagatttcattttcgccaacactgcatttacttccggcataacatctttaccatctacataaaccggtgtatttgcacaattacgaagtgcggtatgtaatacagcacgattttctgtacgattgatcttttcaccattaaacattgcttcagttgcttcattcaaagcacattctttagctaactgacgtaataaagataatgtttgttgattaatattattttttgaataatccactaaaatttgttcggcaaattttaacgaatagtcattaaatcgagtcggttcttgctcaaaaagttgttgaatagtaacttgatttaagtctttttgatgttgctctaaagctttccacgcattagtttgagttggattaatattttgcatcatttttcctctctatggtttaaaaagttaatcaatatattcgatcaatactctaggtgttaatttagtgataagttcatagcttatcataccgctaattgcagaaatttcctcaataggtaattcctttccccataaaataacttcatcacccaccttatcttgactctcaataccaagatctaccgttaacatatccatcgatacacgcccaacaattggtacttttctgccattaatatagaccggtgtaccttgaggcatatcccgtggataaccatctccatacccaatagctacaacgcctattttggtatctctctcactaatccaacttccaccataccccacaggttcaccttttttatgatttctaatagtaattaatgaagaagttaacgtcataaccggaatcaatccataaacctcagcaggcgtattattcggcgagataccatacataataatacctggacgaatccaatctaaataggcttgctgccaaaacaaaatacctgatgaggcaacaatagatcgctcaccttgtttaccctcggtaacttgtaaaaaacgctctaattgaatttccgtataaccacacatcaattcatctgcccgactaaaatgactcaaaaacccgatttcttttacatttgaacattgaacaagttgctgataaaagtcttctacctgttcaagatctacacctaaacgatgcattcctgtgtcaattttcaaccatactttaattttattcggcaacttggctttcttaagctcataaagctgttcttgattatggataactgtttgaatgttattaacagcaataattggcaaatcatcctcggaaaaaaaaccctctaataataaaataggtttagtaataccttcagtgcatagacgtaatgcttccgataatctagccacaccaaaacagtcaaccagatgatgcagagtagaggaaacgaactccaaaccatgtccataagcatttgccttaacaattgcaatgactttactgtttttggctttttgcttaataacttgaatattatgttttaatgcaacagaactaatcctggctgttggaggtatgacattcattgattcgactctaatcttattttgtataatactgcggtatatttgctaaattatcaaaacgtgaatattgcccctgaaaggctaatttcactgttccaataggtccattacgttgcttaccgataataatttccgcaatgcccttattatcttccgttgtttcgttataaacttcatctcgataaataaacataatcaaatccgcatcttgttcaatggatcccgattcacgcaaatccgagtttataggtcgcctatcccctctgttctccaatgtacgatttaactgagaaagtgcaaccacaggaacttttaattctttcgctaatgcttttaaggaacgagaaatttctgcaatttctaaagtgcggttattttcaaatcctggagctcgcattaattgcaaatagtcaaccatgattaaacttaacccgccattttctcgatacactcgtcttgctctggagcgtaattccgttggtgttaatcccgaagaatcatcaatatacaagttaggtttttgcttaaacatcccaaaagttccggaaattttagcaaaatcttgctgtgttaaattacctgtacggattttaacctgatccactcgagaaagtgaggctaacatacgcatcaaaatctgttcagccggcatctccaagctaaaaaccaaaaccggtttttccgataacatcgcagcattctcacataaattcatagcaaatgttgtcttacccatcgaaggacgagctgcaacaataattaaatcggatttctgtaatccggatgttttttgatccaatgcagtaaaaccggttgaaacaccggtcacaccgttatttgttggtgtagccgccagattttcaattttatcaatagtgttaaaaagaagatttattacattttgcggtccttcattagctgatgttcgtttttccgcaatagaaaatatatcacgctccgcattatccaaaatgtcttttattgcttgcccatttggtttatacgcattttttacaatattatttcccactgaaattaactcacgtaaaattgctttttcacgcacaatttcagcataagtcaaaatattggcagcactcggcgtattgttggacaactctgctaaataagcaaaaccaccgacctcttcactttttccttttgtctttaacacctcatcaagaactaataaatcaacaggggtattttgtgcaaataataatgcaatttcttgaaaaataatccgatgctcaaaagtataaaaatcttcggcaatgatctgatccgctacgctatcccaataacgattatctaatagaatcccacctaaaacagcttgctccgcttcaatggaatgaggaggaatgagggtttgctcaaattttttatctttgatccgtgcagattgatttgaaccggtagttgctttagtcattaaaagaaaaattacctaattagaaattgaaaactgtgctatatgatataccaaatctaagcgagaattaagagagagggaaaaattaatcaaaacaatataagtgatgaaaagcaaccgcaccttaaagtgcggttatttttgataaattttacttcttacgtcgttcaattaatgcctcagacaattgttgtaatacgatttctgtatctgaccaaccaatacaagcatcggtaatactttgtccataggtaagtgcttttgcttccactaaatcttgacgaccttcaactaaatggctttcaaccatgacaccaaaaatttgttttgaaccattagcaatttgagtacagacatcagtgcaaacatctaactgttttttaaattgtttactgctgttcgcatgactaaaatccaccataacatgcggaatgcgaccggttttttctatatccgcacaaactgtccgaacatcttccgcactataattaggacctttctcacctccacgcaaaataatatgacaatcctcatttccttttgtagacacaattgctgaatgaccaaattttgttacagatagaaaataatgtggtgcttctgccgtacctattgcatcaagagcaatgcgaactccaccgttagttccattcttaaagcccaccgcacatgacaaaccggatgccaattcacgatgaacttgcgattccgttgttcttgctccaattgccccccaactcataaagtccgcaaggtattgcggtgaaatcatatctaaaaattcaccggcagtaggcatttccatatcgttaatatcagataataatttacgtgcaatacgcaaaccatcatttaaagcataactaccatctaaatgaggatcattcactaatcctttccaacccacagttgtacgtggtttttcaaaatacacacgcattataatttccaacgtatcatgatattttatacgcatttctttaatgcgtttagcatattccaacgcagaagcaggatcatgaatagaacaaggtccaataataacgagtaaacgatcatctttttgatgaataatgttatgtgctgccaagcgggctttttttactgttttaatggctacatcacttgcaggaaatttttctaataatgcaatagggggcaaaacttgctcaacttttgcaattctggtgtcatcatttgcaatacgaatattatttttattcttagccatatactactctctcttactacataaaatttacaatcatagaattaacaatttatatttaatggtattaaacgtaacatttatttttgtactagtaaactaatttctcctagtacgcacttaagacttgtgcaggttgtaatttagccgctcggcttgctggatataaacttgctaataaactcaacatcaaagcgaccactagtaccataagtacatcttgccaatgtaattcgctcggtaaaaaatcaataaaataaattccatctgataataactttttatccagtaaaaattcaataaattgaatcagatcggttaaatttaaactcagtattacccccaatgctattccaactaaacagcctttcatacctgattgcaacccgtaccaaacaaaaatttgtttaataaaacgattattagcccccaatgtacgcataatagcaatatcagcctgtttatcttttactgccataatcaaagttgacacaatattaaaacaggcaacacctatcaccaacaccatcgcaatatacattactgttctaattaactgaatatcgttatacatataaccaaacttgccaatccaatcttgaacttgtaggcgttgcggataatcatataaatattcatacgtcatatttctaaccgcaaaaggatcttgaacttttagctcaaccccagtaatttcatcgggcgcataatccaataatacttgtgcttgcgataagctcatcaacgcataactatgatccaattgcccatctaaacgcaaaatacctgttacttgaatgcgataacggagaggctgagataattgattatcgctattagcaaaagaaattaataacgttacccaatcattttcggatacacctaattctttcgcaatgccatagcctaaaaccaaaccgccatttttctgaaattgttgccagccatcatttaacacaaatttactcaaattactcacttgatcttgtgtaacttgttctattcccctcacttgagctactttcagttttgtgccgttttcaattaatgccgtaaattcaacaaaaggggattgtgctaaaacatttggatcctgctgtaaaagtgcggtaattttttgtcgactttcaatcttgacatttccttgctcttgatacgatataatttcactatgtggaacaacagataaaatacgctgattaagttctcgctcaaaaccattcatcgcacttaatcctacaatcaacactgccacacctaatgcaattccaatagttgaaaataaagcaattaatgataccaacttatttttagaacgactgtattgataacgccagctaataaaaaatggagtattcatgagttactttccctcaagataccgtcttgcatcactaaacggcgatccaacttttccgctaattgcaaatcatgagttactaataaaaatgcaattttttgttcctgattaagtttttggataagttcaaaaatactttctgttgtcttatgatccaaatttcccgtaggttcatcagccaacacgagttttggattattcaccaacgatctagcaattgcaacacgttgacgctctccgccagaaagtgcggacggtttatgcaaaattctcttagccaatcccaccgcacttagtatattctcagctcgatctttcgcctctgttttatttttgtgactaattaacatcggcatcatcacattttcaagtgcggtaaaatccgccattaaatgatgaaattgatacacaaatcctaaatactgattacgcagtttagctaattcgtcctgtgttgccctttgtagtgattgcccatgaataaaaacttcaccgcttgttggctgatctaatccgcctaacatatgtaaaagagtacttttgccggatccggaacttcctacaatagcaattaattctccttcctgcatggaaaaagacacctcttttaagacttgagtttgaagacttccttcctgataatgctttgtaatattttgacagattaataatctattcatcgtttgctccagttctcttattattcataacgtaatgcttgtgctggctcaattttactcgctcggtaagccggataaattgttgatattaaagataatgttaacgagaaaaataaaattaacgcaatttgataaacgttaatttctgtcggtaaaaaaataccctgaggattaatccactgaataatcttcgccaaattcattgctacaacaacccctaagccgccacctaacacagcaccgcttgcccctacaaaaaaaccttgcaaaataaaaatattacgcacttgtccttttctcaatccctgtgtttgtaaaatagcaatttcaccttgtttatccaccaccattaaacttaatgaagtaacaatattagaaaccgccaccacaataattaaactaattagcaagctcatcatattcttttccatgcgaactgcttggaaaaactcccctttttgactacgccaatctacaattttccattgctcagtagggaaaaacttaggcaattcactaatgaaaaaaggatcttgcaaaaataagcgataaccttgaacttgttcaggtttaatccgcattaagcgtccaatatccgctaaattggcaaaaactgcatagcttgcctgttcagaaaaggaagagtaaatatcactgatggtaaataaacgttgtaccggaactcgaccaaagggagtatattggctattttccgtcaccatcactcgaactttatcaccaatctgtacgtttaatttttgtgccaatttccaaccgataattaatttaaactcaccgattgaaagaagttgcgaaaaatgattttctgaaaactcactcaataaaggatcatcagaaaatttttgcaccccaagaatttgcccggcactgacaccttgtgcagtttgaaacacggcagaagttgtattaatcggcacaactttttgcacaaaatcgggcatgtccggttgcgaatcggtcaaatatatagaattatttttaggcattaaaatactgtgcggaatattggaaagaacctgttgtttttgatatttttccaagccgttcatcacagacaaaacaataattaacgccataacacctaaaataataccaacggtagcaagcgtcgtaactaattgcccgaagtgatccgcacttttagcccgccaatagcgtaatgcaataaaaagagaaattggaaaggtcatcttataatctataaaattacaaatctatgaattcacgttgcgactacatcaagaaaataaaaacaataaaattggatttattaaaccagtgttttctttgttactgaaaattaatctaacaaacccaatttagtcatttttactgagtaaataaaatcagcttaactaattatttacctgttttgacaaactcttcaatattttgtgcaactttgttcaccaaagtggtcaccgcactatctgatgcccatgcaatatgtggagtaacaatcaagtttggtaaacgagtagctgcctgaataagcggattctctttctcaggcggctctttaaccagtacatcaatagccgctgcggcaatcactttattttccaatgcttcaaccagtgcctgttcatcaactaaagggcctcgtccggtattaattaagtaagccgtcggtttcattaactttaacgtttctgcattaatcaaattttgtgtttgctccgttaaaggacaatgcaaagtcacaatatccgcttgctttaaaacctgttcaaaaggtaaatatcccgaacgaatttccgttgcaccacaacgttcagcgtaaatcacattcataccaagtgcggtcgctaatcgaccaatttccgaacctaaacaacctttaccgatcacgcctaaagttgatcctttaacatcggtaatcggataatcaaaatagcagaattgtttacagtctgcccattttgcacttagctgatctctgtaccaattcattaaactatgttttaaggcaaaaattaaacctaagacatgctcaggtacggttaccgaagaatagccggttacattttttactgtaatacccaattctttagctgctattaaatcaacattattcgttcccgttgccgtaatagcgattaattttaacttaggtaattgcaacatcacctcacgactgaaaataaccttactggtaataacaatatcagcctcttttgcacgatctatcaactgatcagcatcggtatattcatattcaatccattgatgctcaaaacttgggcgaggaatagtaatatgttttggaattgccgtactgtctaaaaatacaatttgcatcattttctccttagttaattggaataggccgtgtcaatataccaaagtaataaacataaatatagaaaaaatccgtattcactaaaaatacggatttttcattatgctcatttaatttgaagtatctatttcctcaaaagatttaactagatcatcaatagctttcatttgtgcaacaaaaggttcaagttttgataaaggtaatgccgatggtccatcacactttgcttggtttggattaggatgagattctaagaataatccggctaatccaatcgccataccggaacgagccaattcggttacctgatcacgacgaccaccggaagctgccccaaaaggatcacgacattgtaaagaatgagttacgtcaaaaataacagggcaaccttgcgacacttttttcataatattgaaaccgagcatgtccaccactaagttgtcataaccaaaattagtacctcgatcacacaaaatcaccttattatttccacattctgcgattttttccacaatattacctatttgacctgggcttaaaaattgtggttttttcacattaatcaccgcacctgtacgagccatcgcttcaactaaatcagtttgacgagctaaaaaagccggtagttgaataatatcaacgacttccgctacaggtcggcattgataaatttcatgtacatcagtaatcacttttacaccaaaagtctcttttaattcttggaaaatttttaatccttcttccattcccggaccacgataagaatgaatagaagatcgattagctttgtcaaatgaggctttaaatatatagggtacgcctaatttttgcgtaacttctacatatttttcacaaacttgcatcgccatatcacgactttccaacacattcataccaccgaataaaacaaaaggcttattattgccgatttcaatattgcctaactgaataacttgattttgcataatcatttccttactaatgaatagattcaatttctaattgtaaatattccaattgaggtaataataaaagtgcggtcggatcttccggacatttttctaaaaaatattcaaagtcattcaatgccgcttgcatacaccccatttgagttaataccaccccacgatcacgaatttcataaggatcatcaggatttctggacaagagcatatcaatatattgatatgcctcattatttctaaattcacgaattaacgcatgctttgctaattgacaaaaccgattcgttaattcttgcacatctgcaacttctaatatctccaagcttaattcagtaccaaaaccaaatgctccttcatataacttttttagctgagaatatgtcatatattgaccattccaaggatcaataaaggcgacctcttcatcaacatcagcacgcaaaattaattgcgtaggaaaattgaccggataaatgggcaaattcaaactttcagccaagtataaaactattgctcccagtgttaccggcattcctcttcgttgcgttaacacttgatccaaatataaattctccaacgcaaaataccgttcgggatcacaaaaaaatccccattctccatacatcaactgcaataaatgatgaatttttcttttagtttcccaattagaatcaatttttttacgagcttcacgaaccaaaccaccaatcatgcctcgaatacgccgtatttctttactactattgtcatgcgtaataagataaaaagaggtcatttcatcatataatgctttatgataatacttcattttttcctcttaattgagctaatgttattcgctcattaccgccataatcgttaatcgtttcaacttgtttccacagtttctcggcaaaaaaagaccgcactttttgcccttgctgccagccatgctctactaataaaaaaccttgtttttttaaataattaggagcttgctcaataatatattgcaaatcggcatatccttttttttctgccaccaacgccgtcaaaggctcaaaacgtacatcaccctgatttaaatgctgatcttccgcatcaatataagggggattactgacaattaaatcaaattgtccagttacttgctcaaaccaattactttgcaaaaactgtacttcggtcaaatgattacgcactgcattagtttttgctaatttaacagcgtcggcaataacatccagaccaaatatctcaaaatgttgaccgctctttttcagttcatcagccaacgccaaagctatagcaccagtccctgttcctaaatctaaaatacgaatgggggattgagtaaagtcttttgatttcttaagcaattgaatgcaaaccagtgcttgttcaaccaaaatctcagtatctggacgtggaattaaagtatagggagccacctgtaaatttaatgtccaaaattccgtttcacccagcacatacgccattggttcacctttagcacggcgaaccaataattctgtgagttgtttcaattcatcctctgtcaataaggtttctgaaaaagctaaaatcgctgattttgaacgtttggtgacggtttgcaataacaaatttgcatcaactttagcatctaagaaaggatctttagcaacattctcaaataaacgtttttcggcaagttccagccattgttgataattcatttctttagtgaaacttaagttttcttcacaacgatagtcgacataactatatccactaacgaacgtctttccttatttgcaaaagcaacaattgcactaactaaagttaagatacctgttaatgcaaaaagctgttcaataaattcacgcaatacataacgacccaatgttaagggttgatttgttctatagtctatcacttgtaaatttagccatttctttgctaatgtttgcttagcgttatacatgaggaataattgatatccgatatagaggaaaataaaaatgagacctgcaatctggttcaaaacaatagatccaaacaaaatagccacatagaacaacaatacatttatgagggaaactaaccaacgcttaaatcgactagcataaacaatatctgatacgttattagaatttgcttgtaatttatgatcttcttcaacaataaatttacgattttcatcattagaattgtttttttcattgaatttttcaacaatcatcgtatctccttctcataatcttaagaggaattttttcttcgtcagaatagattaattttgttcggacaacattgccaactgatctgcttgatattccgtaataattggttgaattagctcgtcaatcttgccattcatcacttcatcaaggcgatataccgttaaattgatacgatgatccgttacacgaccttgcgggtaattgtaagtacgaattttatctgatcgatcgcctgaacctaataaattacgacgagtatccgcttgggcttgagcttgacgttcctgttcagcttgtgcaatacgagaagctaaaacggaaagtgccttcgccttattcttatgttgtgaacgctcatcttggcattccactacaatacccgtcggaatatgcgtaatacgcaccgcagaatccgttgtattaacatgctgaccacctgctcccgaagagcggtaggtatcaatacgcaaatccgacggattaatctccggcatttcattttccggtaattcaggcataacagctacggtacacgcagacgtatgaattctgccctgagattctgtttttggtacacgttgtacacgatgcccaccggactcaaacttcagttgaccatacacgccttcgccattcactttgacaataatttctttatatccgccttgctcactttcatttgcattcaatacttccacacgccaacgtttactttctgcataacgactgtacatgcgaaataaatcaccggcaaaaataccagcttcatcaccgccagttccagcacgaatttctaaataagcattgtattcatcatttggatctttaggtaataacaggatttgtaattgttgctccgcattttcaatttcagcttttgactcttctatttccaattcagccatttctttcatatcaggatcatcaagcaatagttgtgtttcttcaatattgttattcaaccaattccaacgtgcaaaacattttacaacatcttctaattgagcatattcttttgaataagcacggaatttatcttgatcgttaatgacagacggctccccaagcaacgcttcaagttcttcatgtctctcttttaagctctctaatttactaataatactggctttcattctctaaccttacaaaataataatgtaaatttaaatttcaaaatttaatatcaccgaaccattggtatattttatcgtgtattcgagtaccataaaaatcgacaatatttctatcatatttgaaaacagcggtggaaaataaggtaatcactctttcaaaattcacatcaagcaattcaaatagttcactcggcacaacatcttgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctttttaatggcaacatagtgcttgattttatactttttatgtaattcaaaatcttcattaaaaacaaataacacttcatctaaatgatatttatttaacatcagaaaaatcaacaacattcttaaactgctgacaataacaattgctttgattttcatattacacttcatgatattcaactattttggctctaaatcttggattattacccaactccgaaaacagaaaattcaattcgaggctgccttagaattacctaaaacagcctctatataataaccataatagcagagctacattacagaaacatttaaagtggagccaccaacaatacgaactcgagctcccggcactaaagttgcatcatacttttgcacaacaacaatttcttgtccattgtcttttctgataacaagttccaacgcattaatctgacttgctttttcttctactttactgccaattaccgctccggcaatagcaccaactgctgcagcgactgcctgtccggtaccaccgcctatactagatcccactattccacctaaagcaccaccaccaacagtcccaatcacaccttggttatcgccttgaattttaaccggacggattgattcgatgataccataactgattgaacgagctgatttagcttgtgtgccactatatacattaccactgtatatatcttcattggcacacccagctaatcccaaactaagtaaaatagctaatgataaagtcatttttttcatagtagttaacctctcttttttgattaatttttagatgttctagaaagccaagaacttgatcttttacgagaaatatttgttactgttataccatcgtcattgtgagagacctctacacaagagcctacaactaaatgagaatcgtaagaatgacttaatacgatctccttaattcctccctcttgctgtttgcaatcatttttacgaatagttaattttaaattatttcctttttgagtagcgaacaaaatttcgcccttatacacattatcattttttgtagatgagcaagctgctaatcctaaaaaacctaataataaagtgaatgctaatgttacttttttcatcgaatctaaccctcaattatctttttgatatgatacgggtgaacttttatgcaagtatgattttctagttgattaacaaaactcactgcaatagacgggttaggtaattgctcgccatccaccttaggttcacttactttaactttcaaattagccaattcctcccataaaaattgttgtcttatacgtgtaacccattcatcaacagtttcattcacttcaaatggaattattacttcaatatgctcccagttttccactggatacactttatctttagggaacggtaattcaataatatcaataaactgatccgaaaaacgtatcggattatcaagttgaattaaataaataactctcccgtttacaatattaccgctcagaattgtaccgcactttaacagcaaagtcagccaatcctccgcagatttacgtttatttactctcaaggcaatatgatcaatttcaacacgatctaaccgtaattgcatggaatgggctaattcaataatttttttttcaaattgttcaaactcatctaatgagatattagattgccgaaacaaagaatgattttggttaaaaatctgcattttttattgctttatcttttctgaataaggaaagagcggtatcataacgcattattttcacaaatcaattattaggtatatcagtgaatattcagtctattttatctaacaaaatcaaacaagcgatgcgtcaagccggtgcagatgaacaatgtgatgctttagtgaaaccatccggtaaacctcagtttggcgattatcaagctaatggaattatggcaacagctaaaaaactgggtttaaatccccgtgattttgctcaaaaagtactcgatctcattgatttaaaaaatattgccgaaaaaatggaaattgcaggccccggatttattaatatcttcttagataaaaattggttggcagaaaatattcaagttaccctacaggataagaaattaggcgttacagtcgaagaaattcaaaccatcgttgtagattattcctcaccgaatgtagcaaaagaaatgcacgttggacatttgcgttcaaccattattggcgatgctgtagttcgtacattggaatttttagggcataacgttattcgagcgaaccatgttggtgactggggtacacaattcggtatgcttattgcctatttggaaaaaatggaaaatgaacatgcttcagcaatggaactggcagatttggaagccttctatcgtgctgctaaagaacattatgataatgatgaaacctttgcagaaaaagcacgtaattacgtggtaaagctacaaaatggtgatgcttattgtcgcacaatgtggaagaaacttgttgatattactatgcaacaaaatcaacgtaattatgatcgcttgaatgtgaccttaacccaaaatgatgtaatgggggaaagtctgtataatccaatgctacctgaaatagttgcggatctaaaagcacaaggtttagccgttgaagatgaaggtgcacaagttgtttacctcgaagaatttaaaaataaagagggtgatccgatgggggttatcgtgcagaaaaaagatggcggtttcctctacacaacaacagatattgcggcggctaaatatcgttatcatacattaaaagcagatcgtgctttggtgttttccgacacacgtcaaagccaacatatgcaacaagcatggttgattactagaaaagccggttatgtgccggacagtttccagctggaacataaaaatttcggtatgatgctaggtaaagacggaaaaccgtttaaaactcgctccggtggaacggttaaactgacagatttattagatgaagcgattgaacgtgcggataaattaatttcagaaaaaagtactgcactttcaagcaaagaaaaagcggctgtgatagaggctgtgggtatcggttcagtcaaatatgcggatctttctaaaaatcggacaaccgactatgtatttgattgggatatcatgttaagttttgaaggaaataccgcaccttatatgcaatatgcttatactcgtattcgttctattttcaacaaaaccgatattagtgaagaacaacttcaccctgcaaagatccagctcacagatgaaaaagagcgtttacttgcaattaaattgctacaatttgaagaaacagtacaaattgtaggcaaagaaggaacaccgcatattctatgtgcctacttgtatgagttagccggtttattctctagtttctacgagcattgccctatcttgaataatgataatgaaaacgtaaaattaagccgtttaaaactcgccttactcaccgaaaaaaccttaaaacaaggtttggatttactcggtataaaaacagtggaaaaaatgtagttcagatatttccattattggttcgtataaaaaaggcaacatccgttgccttttctgtaggttattaatttactcatggtgtcaacaaagttcttaaaactttaccaatatcagccaaacttcttaccgttttcacgccggctttttccaaagcgacaattttttcctctgccgttccttttccgccactaataattgctcctgcatgtcccattcgttttcctttcggagcggttactccggcaatataagccacaacaggtttagttacatgtttatggataaaatcggctgcttcttcctccgcacttccaccaatttcaccaatcatcactatcgcatcagtttcaggatctgcttggaataatttcaaaatatcaataaaactggaaccggggataggatctcctccaatccctacacaagtggattgtccaaacccctcatccgttgtttgttttactgcctcataagttaacgtgccggaacgagaaacaattccgatacgcccttttttatgaatatttcctggcataatccccattttgcattcctctggtgtaataacaccgggacaatttggaccaatcatcacgacatcactttgctgtaatttttttttcacctccaacatatccaacgttggaataccttctgtgatgcaaacaataaacttaatgcccccatcaattgcttctaaaatagcatctttacaaaaaggtgccggaacataaatcatggttgcggtagcaccagttttctccactgcctcacgaacagtattaaaaacaggcaatcctaaatgcaacgaaccactttttcctggggaaacccctccaactaattgagtgccataagctaaggcttgttcacaatgaaacgtgccttgtttaccagtaaaaccttgacaaatcactttggtatttttgttaattaaaattgccattattcactctcctttgctgcattaactgcttgttccgctgcttcagttaagctgtttacagcaattaaattcaagttactttgtgctaaaatttcacgtcctaagtccgcatttgttccttccaaacgcacaacaactggaacactcacaccaatttcattgattgcggaaacaattcctttagcaattaaatcacaacgcacaataccgccaaaaatattcactaatacggctttaaccgcactgtccgttaaaataattttgaatgcttccataacacgttcttttgttgctccaccaccgacatcaaggaaatttgctggtcgtccgccatgtaatttaataatatccatcgttcccatggctaaaccggcaccattgaccatacaaccaatattcccatttaacgcaacgtaatttaaattccacttttcagcctcagcctcacgaggatcttcttgcgttaaatcacgcatagaaaacaagtcaggatgacgatacaacgcattatcatcaaccacaacttttgcgtctaagcaaaataattcatcgttttttaaaataaccaatgggttgatttccagtagggataaatctttttcaacaaataatttggcaagttggcaaaaaatttggctgaattgctgaatttgtttccctgataatcctaatttaaatgccaattctcgcccttgatatggcatcgctccaaccaaaggatcgatagttaccctatgcaataagtgcggtgttttttctgctacttcttctatatccataccgccttcacttgatgccataaagacaatacgttgagagctacggtcaataattgcactcaagtacaattctttttgaatttccgcacagggttcaagataaatttgatgaatcggttgtccctgttcatttgtttgaacggtaactaaacgctgtcctaaaaacttagtaaaaaacgaccgcacttcttgtgctgatttaaccacttttactccaccagctttaccacgtccaccggcatggatttgacattttgcaatccattgagaacctgataatttctcaatcgcacttaacgcctgttcaacattttcacaaacataacctttagttacaggtaaaccataatctgcaaaaagttttttactctgatactcatgtaaattcatatcgtccccttattgatacgtttcaataccgcacttttagattatcggtacttctaaatttccagtagcaagcgagtcggatcttccagcaagtccttcactgtcaccaagaaaccgacgctttcacgtccatcgattaaacgatgatcatagcttagtgccaaatacatcattgggcgaataaccacttcaccattaaccgcaacgggacgatctttaatcgcatgcatacccaaaattgcactttgtggcggatttataataggtgttgacattaaagaaccaaaaacgccaccgttagtaatagtaaaattccctcccgttaaatcttcaacggtcaattttccatcacgacctttttccgccaacaatttaatttctttttcaatatctgccatacttaatttatcgcaattacgtacaaccggcgttaccaaacctcgaggtgtggaaacagcaatactaatatcaaaataattgtggtaaacaatatcatcaccatcaatagatgcgttaatctctggatagcgttttagtgcttcaaccaccgctttgatataaaaagacataaatcctaagcgtgcaccatgttgtttctcaaatttttctgcataacgcttgcgtaaattcataatcggctgcatatccacttcattaaatgtcgtcagcattgcagtagtattttttgcttccagtaaacgctctgcgatacgcttacgtaaacgtgtcattggtacacgtttttcattgcgatgatcaattttcaacccagttgcaatagactgagatgcttgtgccgtttctgtttgttgtactttttgcttaaccactaacgctatatcttcacgagtaattcgaccacctacacctgtacctttaatttcatcagcatttaattcatgctccgctaacaaacgacgaacagccggactcagtacatcgctacttgcatcagtattcaaattagccgaatgacgatctgccggtgttttttccacattctgtacagttgattttgtaacttctccaatacctgccgaagcggatactttacccaacaattgtttactcacgacagttgaaccttccggttgtaaaatagtttcaagcactccatcactaagtgcgggaatttccaacacaattttatcagtttcaatttccaccaaaacttcatcacattttaccgcatcacccacgttcttatgccacgttacaacggttgcatccgccacagattcagggagatccggagtaataatatcgaaattgctcatattttttcctcctattcatatttcgcttaaaattagatatatattcgttaattattgaaaatttttccaatactttaacctagcaaaattacgctaatgcctcagttaccaaagctcgttgttgctcattatgtagagataaatagcccactgccggtgaagctgaagctggacgaccaacataacgcaacttaccatgtgggggtaatgatgtccaaaaattatgctgacagcaataccaagcaccttggtttaacggttcttcctgacaccaaacataatcagttacgtgagagtaaggagctaaaacctctttcatttcttcatgaggatacggataaagttgctcaatacgaataattgccacatctgtctgattatttgctcgacgttgttccaataaatcataataaacttttccggaacacatcacgacacgacgaactttttgaggatcaatagcatcaatttccgcaatcacattttgatattttccattcactaactcctccatagtagataccacaagcggacgacgtaacaatgattttggtgtaataacaattaatggacgacgtactttacgcaacatttgacgacgtaataaatgataaatttgtgccggagtagaaggtacacatacttgcatgttttgctgtgcacagagttgcaaataacgctccaagcgagcagaagaatgttctggaccttgcccttcatatccatgtggcaacaacatcactaaaccacacatacgtccccatttttgctcgccggaactaataaattgatcgatcacaacttgtgcaacattcgcaaaatcaccaaattgtgcctcccaaatagttaatgtccgtggtgccgctgttgcgtaaccatattcataagctaaaacagcttcttctgataatacagaatcccaaacttcaaaacgcccttgttgagcatgtaattgagttaatggaatatacaacgtcgcatctttttgattgtgtaatactgaatggcgatgaaagaaagtaccacgtcccacatcctcaccagataaacgaacattatatccctcatcaagcaaggtcgcataagccattgtttcagccataccccaatcaaataatttatcgccttgtgccattgataaacgatcatcgtaaagttttttcactcgaggatgtaatgaatgcgaacttggataatcacatactttcttagctaatccgacaaaacgctcagaatcaaaggaaccatcatactcagtccattcttgcgttaagtacttagtccaatctttcgtttcaatatccgcttcacgccattccggtacaacacaacctccattatccaaagcatctcgatatttatttgctaattcaattgcatatgcttcatcaataataccttcagtaactagacggttcgtataaactttcggaggtgttggatgcttacggatacgttcatacataagcggttgagtaacagcaggttcatctgcttcattatgcccatgtcgacgatatgacaccaaatcaataaaaatatcacgcttaaattttgctctaaattcaaccgccattcgtgcagcataagcaacagcttccggatcatcaccatttacatggataaccggtgcctcaatcatcttcgctatatcagtacaatattctgttgaacgtgtatcctgtagatttgaagtggtaaaaccaatttgattattaatcaccacacgaattgtcccaccaactgtatagcctctcacttctgacatattcagtgtctcttgaacaatgccctgccctgcaaccgcactatctccatgcaccgtaattggtaacacttgagaatgttcaacgtcctgaatacgattttgtcttgctcgcacagaacctaaaacaacaggattaacaatctctaaatgagaaggattaaatgccaatgctaaatgtacaataccattgtccgtcataaaatcagatgaaaatccctgatgatatttaacatcccccgtcccactgccactatgcttaccggcaaactcatcgaataattctgaaggctttttacccaacacattaaccaatagattcaagcgacctctatgtgccatgcccatcacaatttctttcacaccatttctgctactatgacgaatcatttctttcattaacagtataaaagcatcgctaccttctaaagaaaagcgtttcgctccgggaaatttcgcccctaaataacgctctaatccatctgctgcaattaattcttctaaaaatttcagttgttcttctcgggtgaacagcggtttatctaataacctctcaactttgcgttgcaaccacgtacgagcgtcaagatcgttaacatgcataaattctaaaccaatcgtactgcaataagtctttttcaacgaatcggctaaatcacgtaacgaaatttgctccttgttataaacataaccgccaatatcaaaaacttcatctaaatcattatcagaaaaaccataaaacttataatcaagcgttggtgcctccatacgttgccacatttttaacggatccaaatccgcatgtagatgccctcggttacgatgcccatttatccatttaagcacattaaccaatctcgcactaacattaggatctatcacccccaccccattttgagaagtatcacgtgctaaacgtttaaaataatcacggacttttgaatgaggctgctcaagtgcgttctgttttggaagagaattgaaaacttgttgccaactttcgtcaacagcttgagggttatcaagataatcttcataaagatcctcgacataagactggttcgcaccacctaaagcactggatgccaaccattcactgatagggctattttttttcattatgaccacctaacttgattattgatagcaatttacagtgtaattttttccattatacatagatttagccataaacaatctatttatttgataagctatatcaatttcagctggaaattaaaaatcaaattacctatctaagcaataaaaaagttaaaaagttgttaataattttttatttttttgatctacatctcatttttaaacatccaacaccttatttgtaaaaataatgtaaaatttatgcagacagtaacaaaattaaacgttatattgaaaacatacacaaatattcaacatcttactttctttataaacttttaaactctcaagggggaatgtcttatgtctaaattaacagcaaaacttacacttagtgacggacgtgaatttgatttaaatgttcaacaaggaacgcttggatacgatgctgttgacgttcaaccgttagttaaaaataaattatttacttttgaccccggatttatgtcaactgcctcttgcgtttccgaaatcacctatatagatggtgataacggcgtactgttacatcgtggttatcctattgcggatcttgctaaaaatgcggattatttagaagttgctcatctactgttatttggagaacgcccgaataaagaagaatatgccaactttataaagttggtcaaaaatcatactttagtacatgagcaaatttctcgcttcttccatggattccgtagagactctcaccctatggcgattatgtgcggggtaagcggtgccttagcagctttctatcatgattccttggatattaatgatattgaacaccgagaattaacagcaattcgtttattagcgaaaatgccaacgcttgcggcgatgtgttataaatattctattggacaaccttttatgttcccattaaacaaactttcttatgcaggcaattttttatatatgatgttcgcaacgccttgtgaaccttatgaagttaaccctgtattagaaaaagcgatggatagaattttcattttgcatgcagatcatgaacaaaatgcctcaacatctacagtgcgtaccgctgcttcgtccggagcaaacccttttgcttgtatcgctgcaggaattgcctctctttggggaccggctcatgggggagcaaatgaagcttgtattaacatgttagaagaaatcggttctgttgatcgtattcctgaatacattgcacgagcaaaagataaaaacgatcctttcagattaatgggattcggacatcgagtttataaaaattacgatcctcgagctaaagtgatgcgtcaaacttgccatgaagtattaaaagaattaaacattcagacaccgctctttgacgttgctatggaattagaacgtattgcgttaaatgatccttactttatcgatcataaactgtatccaaatgtcgatttttattcaggaattatcttgaaagcaataggtattccgacatcaatgtttactgttattttcgctttagctagaacagtaggttggattgctcattggaaagaaatgtttaaacctggcaatatgaagattgtacgccctcgtcaattatacaaaggacatacagaacgtaaatttgatgccattgaaaaataatttctgtcagagttaaagtgaagctcgtctctttttgaatggcgagcttgattttttgtaccttattctatttttatcaaaatttacaataaatcgtggtaaaattagactaattaatcataatcgggaatttttctatggcatacactaccttttcacaaactaaaaataatcaattattagaacctatgttttttggtcaaaacgtcaatgttgcccgttatgaccaacaaaaatatgaaacctttgagaaattaattgaaaagcaactctctttcttctggcgaccggaagaagtcgatgtatcacaagaccgcattgattatcaagcactacctgaacatgagaaacacatctttattagtaatctaaaatatcagacattattagattctatccaaggtcgtagccccaatgttgccttactgccattagtttccattccggaattggaaacatggatcgaaacttggacattctcagaaacgattcattcccgttcttatacacatattattcgtaatatcgtaaatgatccgtcaatcgtttttgacgatattgtcacaaacgaagaaattatcaaacgtgcaagagatatttcttcttactatgatgatctaatccgtgacagtcaactttacggattatatggcgagggtacttatacagtggatggtaaagcctgtaaagtcactttacgcaacttaaaacgccaactttatctctgtttaatgagtgtaaatgcgttagaagcaatccgcttttatgtttcctttgcttgctctttcgcttttgctgaacgcaaattaatggaaggtaatgcaaaaatcattaaatttattgcccgtgatgaagcactgcatttgacaggcactcagcatatcctcaacatcatggcggcgggacaagatgatcctgaaatggctgaaatcgctgaagaatgtaaacaagaggcttatgagttattcgttgcagcggcggaacaagaaaaggaatgggctgattatctctttaaagatggctcaatgatcggattaaataaagatattcttgtgcaatatgtggaatatatcacaaacattcgtatgcaagctgtgggcttgccattgcccttccaagcacgttcaaacccaattccttggataaacgcttggttagtatcggataatgttcaagttgcaccacaagaagttgaagtcagttcttatcttgtcggacaaattgatgccaaagtagatacaaatgacttcggtgatttcgatctataaaacacctataaaatcaaccgcactttgacctaggttaaaagtgcggttgatttttactaaaaataatgaagatttatcaagtttatatcagcaattaccggcaaacgcttacccatgccaacgaaatgcctttattggaaaaattagaaaaaaacggcattatacatgaatatcaatgtcgctcaggttattgtggttcatgtcgggtaaaactacaaaaaggcaaagtgtcttataaagaacagccccttgcctttcttaatccaaatgaaatattactttgttgttgccaattggaagatgatatagaaatcgaactctaatctatacacacgcaaaaatgcgacttccaattcacttatctcttaaaaaatatttactggttagcattttccttcgttgttacaaacaatagccaatatcctactacagccgatacactagaaccaaacaagatacctaatcgtgcataagcggttaagtgtccatctcccccaccaaaagcaagactggctaaaaacatcgacatggtaaaccctataccacaaagtaccgaaactgcaaatatctgtttaaaattaataccttcaggtagttttgctatatgcagtttcactgataagtagctaaataaaaacacaccaatcggcttacctaacaataaccccaacgtaacacccagtgttaatggtgaagttaatgcttccatacccaaaccggataaagaaataccggcattacaaaaagcaaagagcggtaaaattaaaaatgagctccaaggtgcaatagcatgttccatttcaaccaaaggttcgctgttatttttacctttcagcggtacacaaaaacctataatgacaccggctaatgtcgcatgtacacctgatttcaatacagatacccaaaggataatcccaacgacaacataagcgattaaatttgatactttgaaacgatttaacaaaattaatccaacaatagaaatacttgctaaaatcaacgcttttgtacttaaatcatgtgagaaaaataaagcaatcacaataattgcacctaaatcatcaataatagccaatgctaataaaaatacttttaaagcaagaggtactcgagtacctagcaacactaatacaccaatagcaaaagcaatatcggtcgccattggaatggcccaaccgccgtgataatcaggaacaccttgatttacaagccaatacactaaagctggtacaatcattccgccacaagccgcaattgccggaaaaatagccttctgatagctggaaatcgcaccaatcaacatctcacgtttcacttccaagccgacgagaacgaagaaaatcgccataaatccgtcatttacccacattaataacggtttattaagttcaacgatagatccgaattgaataatcaccggagcattcagaaaactaaagtaatgatctcttaacggagaattggcaaatatcaccgcccctacagaaaaaaacaataacaggattcctccggcggcctccatttgtaaaaattggcgaatacattcccgaattttttcagtcattattttcattattacttcctttgcataactaaaaacgcatataacaagtttttatcacgaacttttattgagggtcaaggcaaatcaaacaattttttctattgataaaaaaaacacaacaaagttcacaataatattcaacaaatttaacaaaactttatacaaaaacaaatttactcaacacatttaaagctgttgatacactctcaacgcatacgcatcggacattcccgcaatataatcgcaaataattcgcttacgatctgtttctgttgctttttgccaacgcattgctgtattacgaggcagtaaacgcaacggatcactgtcaaaaatttgaaacatttcagtaagcattctttgccctttatattcgacacgttgtgtatcaacatgcttaatcacatattcccacacaaatcgtttaaaaatatttagaacttcaataacttcatcaggtaattcggcgttataacgtaataaaggctcggaaaaaccattatttattttccaacgtatatgcgtaataaaataattcaccaatgcaccgatggcatttttacgctcatagtgtaattccgaaaaaagtttttgactgagcgaggatatagtctgaacaatccattcagaacgacattctgctaatttttccaccgcactttgccactgctgaagcgttaccacaccaacaacaatcgcatcttctaaatcatgtaccgcataagcaatatcatctgcaagctccataatactgcaatccaaagatttataacgggttttcaaaacctcatcaggacgagtacgctcttttttatattgcccgaataaagtgcggtcattttccgataagggttcaagtaaccattcaaacattttcaaatcatcacgaaaaatcccttttcccggtttccacgctgaaatcttcacatatttagaatcaacattatcgacaattaccccttgatgatattgtggggaagaacgatctaaaatcgtaggatatttaacaacgcccaataacgttcgacgagttaaattcattcctgcattaggcgtataaggctcaagcttagttaataaacgaaacgtttgtgcatttccctcaaatcccccatgatgacgcatcatataattcaaggcgacttctccgccatgtccaaagggcggatgaccgatatcatgagcaaaacaaaggctttcaatgaggtcattagatggcagtattaatttaagttgtttttgcaaatctgctcgatcttccttgagctgttgagctaaataaataaaactatcaataagtttcatttgtgcaacgatactgctaccaatttgagcgacctcaagcgaatgggttaaacgagtgcggtaaaaatcattttcgcctatagcgtgaatttgtgtttttgcttgtaaacaacggaaagccgcactatgcaatattctcccacgatcacgacgaaaaggcggacgatgatctttctctctcggcggatcggcaagaaagcgttcttgccaagatgaattaatttgcaacttcatatttatnnnnnnnnnnnnnnnnnnnnnnnnnnnnnnnnnnnnnnnnnnnnnnnnnnnntcaacaaaaataataaaatttataaattgatttacttcttttattcgttttgttacgttttttcggtagaataagcgaaattaccttgaataaaatgatcaatatgtggaaaaaaatcttttttattttatttttttgtgccatttctagtgtttcagccaaaaatccccgcattcttccttgttatgtagtgaaaattagtgatggcgatacatttacctgctcacttcgcaataacaaaaaggtaaaagtgcgtttacaagaaattgacgcaccggaaaaaggacagccgtttggtaaaaaagcccaacactatcttacaaagttaatttataaaaaaaacgtaaaattgcatgtgtcaagctatgaccgttatcaacgcatgctcgcaacggtttataactcacaaggaaaaaatattaatttagcgatggtaaatgcaggttttgcttgggcatatcaacaatatttaaaagatccgcagtatctacaagcacaaaaatacgcacaacgtaaacgtcttggcttatggcaagatcctcatcctgtatatccacatcaatggcgtaaacaaaaaaagcaaaagataaaaaaatatgatttttgatccaacattatttcgccagcaatttcctttttttcaccaaaaaaatggtatcacttatctagacagtgcggcgaccaccttaaaaccgcaagttctcctggacgcaacgcagcatttttatgcttctgccggctccgtacatcgaagccaatatgatgcaaaacagaccgcactttttgaacaagcgagaaagcaggtcaaaaaactgatcaacgctgaaagtgaagaaaccgttatttggacatccggcaccacacaaagcatcaacattgtcgcctacggcttaatggcacaactttccccaaacgatgaaattatcattagcgaagcggaacatcatgcaaattttgttacttggcaacaaattgctaaaaagtgcggtgcaacattaattattttaccgttgcaagataatttactcattgatcaacaaattctacaaaaatccttaaacaaaaaaacgaaattagtcgccttaaatgtgatctccaatgtaacaggaacacaacaaccgctgacacagcttatccccatcatacgagaaaaaagcagtgccttgattttattagattgtgcacaagccattaaccatcaaaccattgatcttcaaaggcttgatgcagattttatcgttttttccgcacataaaatttatggaccgacagggttgggtgtattaagcggaaaacgttctgctttagaacgattacaacccagttttttcggcggaaaaatggttgaacaggtttcaaaacaagaaactgtttttgcctctttaccttatcgcctagaaagcggcacacccaatattgctggcgtaattggtttcggtgcggtattaaattggctggaacagtggaatatcacacaaggggaacaatttgccgtgcaactggcggaaaaaacaaaagagcggttaaaaaattatcctcattgtcgcctatttaattcgccacacccaagcacatttgtttgctttacattcaccacaatcgccacatcggatattgcgaccctacttgcagaacaacatattgccttgcgtagtggcgaacattgtgcaaaaccctatttacagcgtctaggacaaaaaagcaccttacgcctctctttcgccccttacaataaccaagaagatattgaactgttttttagtgcattggataaaagtttggagttattggcatgattgaacaaatcaaacaagcgaaaaattgggaagaacgttatcgcttaatcattttggcaggaaaaaatctccgccaaccgacagaacagcaattggctgaaatggaaatcattcaaggttgcgaagtcaaagtatggtttaaatgcttacttaaaacagaccgcacttttgaatgccacgcttatagcgaagcaagaattatgaatggcttattatggatgttattgcaagaaatgaacggcaaacaggcgactcaattggcagaatttgatttaatccaatatttcgatgaactcggcattgcccaacgtttaaccgatacaagacttaacggcttaaaacaaattgagcaaaagataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctttgctacagtaggggcgaatcacattcgccccatgacatccacccgaacggagaataaaatacattaaagggcggatgtaatctgmyyctccccttgtttctttaaattgtcatcaatgcggatagttaagtttgaagttgtcataatttaggctcacattgcagataaaaagcaaattacattacatttacatttcattataatttaaatataattagaaccaactttaaatagcgtttaaatgtcatttactttggaggtttattatggattatacaaattttaatatgcgacttgataacgacttgcgtagacgagcttatcctattttggagcagtatggattgacaccaagtcaagcggtaagaatgttttttaatcagattgcacaaaccggtaaaatacccttgtcgtttgattgggcggaaaatcaaacgttaaccccaaaagcagcagcacgattacgccaaactgagcaggaattcgccaatggcgaatttgaacgctttaatagcctagatgaactcaatcaagcgataaaggagatttcgcatggctaaacgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggagttacattaccttgatagccatagcgaaatttttggctagcctaccgctctttgttacaaaaatgtcaaaaaaaaccgctccgaagagcggttaaatttttgaggttttattatatattatatattagaagtaaacacgtaagcctgctgcgtaaaaactttctcttatgtttttatcttttgtaggtgctttaacacggctattagcaaattctgcataggctaatagatttttgttaaaggcatagtcagccccgacgataaatacgttttgtactcctttcttatgttcaccaagttttaaatcacctacttttacatcaccgagcgagaaaggaagagaaaatttaccctctatattatcaacagcttgtcttacactattacgttgccattgtgcataaacatttaagacatccggtaacactgcatattttgcaccaacttcaacaaagcgagcggaaccattaaactcatgttgttttttagattgatatactgtttgaccgtattcaatacccaaagatgccggtccgaattctacttgcgttgctaaacgccaagcttgttgttgattatcggttttggagtaaattggaccaggaatggtattttcgttatgaaccgtataaccggcattagcatttacagtaaaatcaccgaaattgccggtatagaatgcagagagaccgtaagtattttttagcctaatatgttttttttctgaatcctttccttgaatatcttttttatgtgcttcaccgaaaccataatcaagaccaaaacctaaagtttgcccttccgctaattggatatctgctgtacggaaagacaccactttatcaccggaagtaaccaagttgttgttaccgccaaagatataggtatgatcatttaattgaacatcatccgcagtggtattttgtttaccgaaagttactttaccgatatcgttatgttttaagcctaaccataatttagaaagtttgatgtcgttaaaagatgtatcttcttttgaagcgtcacctaacccgaaacgaaccgcaccgattgcttttaagccgttttgtacttcatgctccgctttaaattccacacgagatccgttattacgtaaatcggtacgttgagcatcaccgaatttacctaacattacatcaacacgaccgccaacttctactttggtaccgttttgattataaacagttgttgcgtttgctgatgccgcaactgccgctaccgctaatgctactaatgtctttttcataataaaattcctttcaaatttaaattattttactactgaattgaacctttccatatatgaaaagtccaagccaacttttaaaaaaaagcgagcctatattggcaaagaaaccgtttacagtcaactaaatttaataaaaaaatgctaaatttagtgatctaaatcacactttttgaataaattttgaacttttttgcggtacttttatttattttaatgattcgcttaatatcgtttattttccagcaaatacgctacttttgcgttcttctttctctatannnnnnnnnnnnnnnnnnnnnnnnnnnnnnnnnnnnnnnnnnnnnnnnnnatttgattccggcgttagtaatcctaatacttttgaatatgttggattgttttttatctctctattttatataatcggaacccaaaatttagttaaagggggagatatgtacgccattgcttttgatcttgatacttctatgttaaaagagctatattccacagagagttggcaaaatgcttatggtgatgttaaaaagacgcttgaatctttaggttttgatcatcaacaaggtagcgtatattttggtaacgaggatatgactgcggttaaatgtgttttagctacacaaacactatctaagacttactcttggtttaagccgtcagtttcagatattagaatgcttagaattgaagagcttaatgatttatcccctgcgttataagcattattcttttactttataacctctaatacttgttagaggtttttttgtagcttgtgaaatttacctctctcatcgcttaaatattcacttttttcgagcaaataccatgcctttgctttattctttttcttgaactatacggctgttaaccgtataatttaggactattttaacaattaaagagggcgtatagaaatgagaacacaagtaacaaaagcaagattggaagctaaagtaaaccttgatatatacgaattattaaaacaagccgccgcaattacagggcgaaccttaaccgactttgtggtaagtgtagcttatgaagaagccaaaaaaactatttcagaacatcaaattttacgtttgacattaagcgatcaggctttactcattgacaatctcagtaaaccgtttgagcctactcagtcaatgaaaaatgcacttgatgtgtatgaagaatatctttccgttgcggggaaaaataatgataaatgaaaatttaccttatttaagcgtattgcctttagaagatttgacaattgataggaattcattttcctgctcggttgagcctttagaaacctatttttataagtatgcttctcaagatgtaaaaaaaggaattacaaagtgtttcgtgcttataaataaacaacaattcggaattatcggctattacactttatcggcactatcaatccctattaccgatatacctcaagaacgaataagtaaaggtattccatattctaacattcctgcggttttagtaggacgattggctattgatacgaatttccaaaatcaggggtatggcaaatttcttattgcagacgctatttataagataaaaaatgctacggtaggggctgcaattttagtcgttgaagcaaaaaatgatcatgctgtctcattttataagcgacttggttttattgagtttaaaaatttgaaaaaaacacacagaaaattattttatccgctaacttgaaattttcttgaacggttgcttttttagtggtgttcagttccgacaatcggtttgattttttcccatttccgacaagatgggcaattccatgatagtttgtgtgtttggtaaccgcaatgactgcaacgataatcaaagcctcgtgcaattctatctcccacgattttgtgcaataaaatcaaactttcttttgctttgccgttttcagcagcatcaatttggtattgaataaaacgatgtaaaataaatgtacttgggttttgttccagttgttggtgtaatttagtttgtgccgcaacaatgccgtctttttctgcgataagatccgataaagctaaatcaaccgcactattattgccggtttggcttgcccgaataagaaaaagttcaaagttgtctaaccgatttaattcttggtagcaatattttaatgccggtaaaatttcgctcatgtaatccgcattttgtgttagcacattttctagatgttgcaccgcacgttgatattctaaattcacaatataacgttcagcaatgaggatagaggctctaacactcgtttttgaaacattcaatgcttgttgcaaaatatggattgcttgagcttgttgttgctcatcacttcctaaagtcagggaatattcgcagtagtaatgtgctaatgcaatgttatcttccgtaggcgaaattttggcaagtttctcggcaacattgatcgcttttttccattcttttgttttttgataaatgacggctagttgttgtaaagcgttttcagcgtagttcggttcgtcaatcaataaaatataaagattttcagctcgatcataaaagcctatcgtcaaaaaatcttttgctaattgttgtttagcaagaagtttttgttcgaaggtataatttggactgctatccaatgcttgatgaatacgcaaagctctatcaacttcacctcgagaacgatataaatttcctaaggttaattcagcctcaaattgtgaacctgtttcaatgttattttcttgttcctgcttttgtagaatatcaaggaagagatcagccgctttttcgtgttgattagataataataaattaatacctgttacataatcacgagaaaatttattgctaatcgtatcttgatcttttcttgcactacgatgccccatataccagccgtaagctgctgcaatcggtaaaagcaggaaaagtaattcgagcattatacaaccttactctcgatttttgtttaattcatcaattaacgctaattgatgctttacttggcgagataaaaaaagatttctaaattttaatttgatatagaagaaagcggtaattaaccaacctaaaagcagacctagcccaaacaagatagccactaaagttgataaacgtatttcattttgtgcaactacataattaaaggtaataatttgatcattgttagcaccaatagttacagcaactaaaacaaccgtaatcaataaaacaaaacctataatatatttgatcatctgtatctcctataactttctatttatggttaaatcaattagcatcactaaaagctcggccattatgccaaaaaaataaaaaaaacgacactttacgcgtcgtttttttatattttatattacgagtaaatattaacacgctctttcagttctttaccggctttaaaatgaggtacatatttagcacttaaatctaccttttctccggtttttggattacgtcctattctagattgacgaaaatgcaatgaaaaactaccaaatcctcgaatttcaattctttcaccgttttctaatgcttgtgataattgttctagaatgtcttttactgcattttctatatctttcaaaggaacgttaagattggttgatgctaaattttcgataagttctgactttgtcataatatactcctagtgccggttggcataaatcctataattcatgccaaccaaaaagtgaatgaattattcaccttttgccgctttaaatgcttcagccattgcatttggaataacaatttcttctttattcacatttgcaactgccgccgcttcttctgcttggtcttttgctttaacagatagatgaacgatacgagatttacggtcaacaccggtatatttcgcttcaacaacatcaccaacaacaacttcattgctcaaatcagctgtacgaatataaccttcaacgccgcttactaattcaactttagcaccttttgcgtcaacttcaaccactttagcactgaccacagcaccttttttgtttaccgcaatgaaattattaaacggatcttcttccagctgtttgatacctaaagaaatacgctcttttgcagaatcaacttgtaatacaactgcttctacttcgtcaccttttttatagttacgaacagcttcttcacccggaatattccaagaaatatcagataaatgtactaaaccatcaattccgccttcaagaccgatgaaaataccgaaatccgtaatagacttaatcttaccggaaactttatcacctttgttgtgagtttcagcaaactgtaaccatgggttaggtttgcattgttttaaacctaaggaaatacgacgacgttcttcatcgatttccaataccattacttcaacaacatcacctaaatgaacaactttagatgggtgaatatttttatttgtccaatccatttctgacacatgaaccaaaccttcaacaccttctaaaatttcaacaaagcaaccataatcagttaagttagttactttacctgttaatttgctgttcaccggatgattttctgcgatggctacccaaggatcttgacccaattgttttaagcctaaagatacacgtgttttatctttgtcaaatttgaggactttaactgtaatttcatcgccgacacttacaatttcacccggatgtttaacacgtttccacgccatatcggtgatatgcaataaaccgtcaacaccacctaaatcaacaaatgcaccgtaatcggttaagtttttaacagtacctttaacttctgaaccttcagctaagttagctaaaatttcttcacgttcttgactattttctgattcgatgactgcacgacgagataccacaacattgttgcgtttttgatctaatttaatgactttaaattcttgttctttacctaataggtgatccgcttcacgagttgggcgagtatctaccaatgagcccggtaagaacgcacgaacaccgtttaactcaactgtgaaaccgcctttcactttaccgttgattaaaccgataacagttgcttgttcttcgtatgctttttctaaatcaatccaagattcttgacgtaccgctttttcacgtgaaagtttagtttcaccgaaaccgtcttcaacagcgtccaaagcaacgtttacaacgtcacccactttaacgtccaattcaccttgagcattttggaattcttccgccggaatacgagcttctgatttcaaacctgcatctacgtacacgaagcctttttcgatagcaacaacagtagcgttaacgattgaacctacacgagtttcaaggtcttttaatgattcttcaaatagttgagcaaaagattctgacataattaatcttctaaatttaagttaataacgaccactttaatttccataaaaagtggggctgataataaatgtttattcaatccttgaataaacgagttcagattccaacggagagttcatcacacgactgatatgctctaatgcttgtttgatcacatcatcaattgttaattccgtgctatcaagtaataaagcatcttctgcgggtttcaagggagcgactggacgatttctatcacgaaaatcacgctcttttatctcggtcaaaatctgtgcaaagttaccattaattcctttattttgcaactgtttatgacgtctttttgctctttcttccgcactagcatctaaaaaaatttttacttgagcatgcggaaataccactgtccccatatcacgcccatctgcaataagcccttccccgtttgcaaaatctcgttgtaattgcaataacgctgttctaacttgtggaaacaccgcaatttgagacgcagcttcagccacttcttgtgtacgaatttttgtactgacattctcattttgcaaaatgatattcacttcgccatgttgtggaataaattgaatgtcgagactacgggctaattcagtcagtgccgtttcatcatcaagtgccacacctttttttaacgctgccaatgctgtcacacgataaattgctccgctgtctaataatcggaaccccagtttctcagctaaggcataacatagtgtacctttgcccgctccacttggtccgtcaacagtaataatcagatttttattcataaattgaaccttgatacaaaaatgcgtcatatatcatgacgcactttattttttattcggctaatttcttctcaacagccttcaatcgcttgtttattttatcaatatctaaagttaatgcagcagttttacgccataccttatttggctgtaacggaattccggaagaatatattcccggttctgtgattggtcgcatcaccatacccattccagtaattgttactttatcacaaatttccatatgcccattaataacacttgctccgccaattaagcaatagcgaccaactttcaaactacccgccataataacaccgccggcaacagcagtacctgttccaatatgaacattatgtgcaatttggcaaagattatctatgattacattatcctcaatcacagtcgcatcaagtgcacctcggtcaatacaagtgcaggcaccgatttcaacatgattgcctataatgacagttcccgtttgtggaattttaatccagcgaccacgatcatttgcataaccaaatccatcactaccaattaccgcacctgattgaatgagacaatctgagccgattttaacgtcatgataaatattgacatttgcccaaagctgggtattttcaccaatctgcacatgtttaccgataaagcaacctgcaccaatcaccacattgtcaccaagtataactccgtcttcaatcaccgcattagccccaatggaaacatgttgacctaacgttgccgtgtcggaaacgaccgcactttggtgaatgccttgagcggctttgggtgtgctgtccatgtattgtgccaaaatagcgtatgcaacataaggatcttttactacgagcaaattactttgtgcagaacagaattcgatatcactttcggttacaattaatgcaccggcttgtgattgaagcaaatgttctcgaaatttaggattggaaataaaggtcagttggttgttatccgctttatctaaaggtgctatgtccgttacaataacatcggcgttaccacgaatggtagcgccgatttgttgagccaattccagtaaagaatatccttgcattacttagcctttgctggagctggagccggaatagcttttagaacttcctcggtaatatttttaccgtcagcaacataaattgccgttttttcatccaatacaattgtaaagtttttggctttagctacattcgttgtagctgtttgaacctcttttaataaacgttgagtaatttcggcatcacgtttttgtgcttcagcttgaaacgctgcaacatttttttggtgctccgctaccagcttgttaaactcgtcattacgttttgttaccaatttagcaatttcatcttgacgttttttgatatcagcttgacgtagtttcggtgcatctttttccaatgctttactttttgtttcaatttctttttcaaaattgtcacgtttttcaactaatgctttatctgctgcttccagtttttctgctggtgctttaaattcctcatttaatttttgaaactcaagcaagcgagcagggtgatttaaaaacaagtactctgtattaacaacagcgatattatcacttgccattgcaattgatgagcctaatgcgatagaaagagcggtcagttttactgcatttttcattgtttgaatatccttaataaattaattttaattgagttccgtacaatttaattatacgggtttcatatcagactattaattatagccgaaagttccctaaaaagaaccaccaatactaaattggaattgttcaatttggtcaccttgatattttttcagtggtttagcataagagaatactaaaggtccaatcggagaataccattggaacgcaatccctgctgaaactcttatacgagctgggttcccgtagtcaggtatatttttatctccagcaaatggtttaccatctgatttccatttagtattccatacagaaccagcatcggcaaagatagaggttctcactgatcgttggtttttctctgctacaaacggcgtcggaacaataagttcaatacttgccaatgtcatggcatttccgccaacaatatctttgctatggcatttatattggttttggcttgtactttgcataactccagccgcactgttttgcattgcactacaatttctattcccctgataaatcgcttttggtcctattgcaccatattcaaaaccacgtacagttcctatacctccagcagagtaagtttgataaaacggtaaacgtttaccgccaaaaccgtttgcatatgatcctgacaatctacctgtcagtacccaataatgatcacgatccaatggataaaaaccctgcacttcagcactcactttatagtatctgttatctgaacctgggattgttactttaccgccaacattcgctcttactccggaggtaggcaaatagccacggtttaagctgttatagttccagccgaatgaaaattcaaagtcatgcgatttaaaattccatctattagaatcaggataccccattgatttgcgatataaatcacgattatattctttcgtcacattttttaattggctataaatatgccctaaacttaaataataggagttattttcattgaccggaaaacttaaatttccacttagaccgtaagttgtacgtccataggcggctgcagtatcactttttgagttatcgtgtttttcaaaaaatgcgtttccacctaaacttacgccatctttagtaaagtacggttcgttataacctaaattaagacttgtgccataattgttgcgtgaaccggctaaactaatcgaggaacccatgcccaagaaattatcctgtttaatacttgcctgataacttataccactttcggtaccataaccaataccgaagttcaaactccctgtattgcgttctttgactcgataaatgacatcaacttggtcgttaatttgttgattggtttgagtttccgtttccactgactcaaaaaatccggtacgctctagacgaattttccctaactcaactaattgagatgataaccaagccccctcttgttgacgcatttcttgacgtaatgtgctatcggcagtaatcgtattcccctcaaagcggatttgacgaacagaataacgatgtcccgcatcaacaacaaacgttaaatcaatcgttttgttctcttcattaaagactgaactaacatctacttttgccgttgcatagccttgctcgcttaattttgcttttatcaattgttcaacactgctaacttcactacgacggaaagtttctccgacataaatgtttttaagtaacggtgctaactcttctgacataccgcctacatcaccaacgattcggacactatttacagaatacttatcaccttcgttaacttgaattctaactctaacctcagttttttcgtcatttagctgaacatcggtaccaacgatttgaaattttgcataaccatgttctaaataaaaatcacgaataagatccaaatcttggttaaattgattggtatcaaatttattcccaaataacttccaccaagcatccggctgtaattccatccgctcttgtaattggctactgctaaatgcttcattgccctcaaaacgcacttctttcagttttgccacatcactttcttttattttaagttttacttctgcccgatcatttgataatggattaacaattgcctctacagtcgtattataacgaccgacagactgataatgatcaactaaacttccacgaaacgcttccaatttttctcgatttaaaatatcaccgctagcaaatccgttcgctttcaagttttctcgtattgcttcactaggaatagattcatttccctccactttcacttccgcaatcactaagcgtggtactacagaaatgactaaggtatttccttcacgaacagcttgcacattatcatagccacgcaaaaataatagtcttacgacatttgaaatatcactctccgttgctttttgtccaattcgaaccggcaatccagataacaccgcactttccttacctgcttgaataccgtttatacgaatatcttgcacgacaaacggtgcggcaaccagaccagtcgagccaaataataggcttgcaattaacagttttttcattgttagttctatcctctaataaagaaatatctaagagtctgtttatcgattaaacaaaatcctgacgattataaacgtaaaaaatcattaaacaatacaaatattgttaatatcaataataatcccgcaccaattttatacgcaatattttgcatttgctcagataagggcttacctttgagtgcttctatggctaaaaaaagtaaatgccctccatccaataccggcaatgggaataagttcataatacctaaattcacactaatcaacgccataaagctgagatagtacacaaaacctatttccgaagatgccccagcacctttagcaatggaaatcggaccacttaaatttttagctgaaaactctcctgtaagcagcttaccgataatttgaatagttaatttgctcaattgataagttttctcaataccttttataaacgcctcaaaaaaaccatattttaattctgtacgatattcatcacttataggataaatagtcggtgcaacaccaacgaaccatttccctttttcatttaagtgcggtgtaatcaccttatccagccattctccatgacgtaatacttgaacattgaaactatcccctttatcaacaaaactgataaaatcacgccatttcattggttcattttgataatagatttgatcaccaattaataaccctgcccgttgtgctggagaattttcaacgaccttagacagtatcatctcaattttagttcttaccggaacaatccctaatgcaccaaaggccgtttctttttcaggatcaaagttccattcagataaatccaatacttttctttgctcgatatttgttgttgaggacttcaaaagtgttagcgtaacgctttcctcccccatttttgtagcaagaaccatattgatactttcccaatccggtgtcgatgtcccgtcaattgccataatttgtgagtaaggttcaagccctgccttctctgccaaagattgaggaaccacattttcaataacaggtttaatactggggataccgatagaataaaccgtcaaataggctaaaatcgcaaacagaaaatttgctataggacctgccgcaataacaaaagcacgttgcaaaatagatttattgttaaaggcttgtgattttaagttgtcaggaacttgttcattacgttcatccaacatttttacatatccgcctaaagggattgcggacacggcaaattccgtgccttgtttatccactttagaccacaagactttaccaaagccaatagaaaaacgatgaactttaataccgcactttcgtgctgcccaaaaatggccatattcatgtactgaaaccaatacaccgataacaatgataaaagaacctaaagaccaaagaaatgacataataatctctacaagaaataaaaatagaaataagcaaaaaacggaactgccgccgttaaactgtcgatacgatccaatattccaccatgtcccggaataagttgactgctgtctttaataccgcactcacgtttgaacatactttccgtcaaatctcccactatggaaatcgctactgtagtaacagataaggaaataaaagacagacgttctaacacaaaaagatctgccggcacaagattaataaaaagtgcggcgaaaataccagcagtaatcaagcctccaaatgccccctgccacgttttccccggtgaaactttcggtgctaatttatgtttacctaatgctcgacctgcaaaatatgcacctgaatcggctgcccaaactaaaataaatacataaagcaatagcattaaaccatcgtaaggattagaaacgtaattgtccaaacgtaaacgtaatacagcgatgaaaaaagggatcaaagtgcagaaagcaaaaataaattgtaagaaagaggatttagcccaaatttttgccgaagcaggataacgaataacaaaaaataaggcgatgaaccaccaaattaccgccatcaataatacaggttcagcatagttttcaaacactctgccaactgttaaaaaatgtgcctcaccaaaaatccacaaaaaaataaaagccccaaacagccctgtaatcattaaacgccaaaaaaattgtttaacgccacaaaactgtgtccactcccaaatacctaaagcaacaacgacaccaagagataaagcaaaatagaaaggggaaaaccataataacgcaatcaaaacaaccacaattaatacgatagctgataatattcgttctttaagcactactcttctccatcattccgaactgccaaaacgacgttcacgttgttgataagctaatatcgcttgattaaattcctgttcattaaaatcaggccacaatgtatcggtaaaatacagttccgcataagcaatttgccataataaaaaattactaattcgttgctcaccacttgttctaattaataaatctactggaggttgtgaacctgttgttagatgatgttgaaaaatttgttcatcaatctcatcaatatgcaatttattttcttttaccaattgtaccaattgacacgtcgcctgaacaatatcccaacaaccaccataattcgcagcaatatttaaagtaagtgcggtattattttccgttaatttttctgctcttttgattttttcttgcaaacgctcattaaattgagaaatatcaccaataatttgtaatttaatgttatttttatgtaattttttaacttcaatatccagtgtttgcataaataaggacatcaaagcacttacttcactttcaggacggctccaattttcactgctaaaggcatacaacgttaaaactttaattccgatttttctagcataagaaaccgactctcggacagccttaatcccatttttatgcccccaaatacgcatttttccctgttgtttcgcccagcgtccattgccatccatgataatcgcaacatgctgaggaatattgtttaaatttaatggtgttttcgtcattatttaatcgatttttatcgaattgaaattcggttgcgactataccataagttgatacggcttgctatgaaaaggcaaataaacagaaaaaaaatcctcttttaatcggtaaaaaacataagtttagtcgtttagttttcaggcttaacaaataaaatctcaatgttttcatcattaatgctttaaagctgatattttcttttatcgccaatatcaaaatgtaaaggcattctccatttttgaatagaaaccataagaaaaagtaccgcacttacaaccgataaaatatacaccatataagtcaaattaaattgtaggcttaaccaaagtatcgcaacaaaaaatggttgtaaatttaatgcaaacacacggaaacaaaaatattctttgaatgctaatccccctaaagtcaacaatgctccgcccagtgcaaactccggtaaattaaatagttggcaaattaatgcaacccaagttgccatttgtaataacaagcggatattttttaaataaatatgcaaagaagaggcacataacgttgctgcaataagtataccgtaatgtgcaatttccggcttataaggtaaaagtgcggtcatgattgcggctaaagtgaaaccgcaacgatataaaataactgttagataatcccaatgatccataggggatttaatttgaggatctgccatattatgttcctgatgtacgtaaaacaaagctattagccaattctcttgcctgcttatctaccagcaatacatcttctatactggtaattacttggctttcaattttttctaataccgctgtgttaatttttgctatatccgtaaattttattctcttatttaaaaatgcttcaacagccatttcatttgccgcattcaaagctgttgttgcatattgtcctgctgagaaagcctctatagctaattttaaacaaggataacgttggtaatccggttttaagaaagtcaacccacttaattgataaaaatccaatggttcaacccccgcaaaagtgcggtgaggatatgccatagtttctgcaatcggtgtacgcatatcagggttacccatttgtgcgataaccgaaccgtcaatataacgcaccatagaatgaataatagattgcggatgaataattacttccatttcatcagcactggcattaaataaccagcgtgcctcaatatattccaaccctttattcatcatcgttgcactgtctactgaaatttttttgcccatagaccaatttggatgtgccactgcttgctcgggcgtaatatgttcaaacgctttcaaatctgtataacggaaaggtccccctgatcctgtcagtacaattttgctaattcccaattgcgttaatggacaaaaaccaatttgttgctgagcttgtggaggtaaagattgaaagatggcgttatgctcgctatctaccggcaaaagttgagccttattctttcgtacttcatcaataaaaatcttgccacaggttaccaatgtttctttatttgccaataggatacgtttacctgcttgtacagcggataacgtcggcaataaccccgccgcaccgacaatagccgccattacttgatctgcctcaggatgagcagcaagttcgcaaatcgctttttgtccgctcaacacttcagttttactctccaagaatgccaacttttctcgcaattttttcgctgcactttcatcattcattgccacaaagtgcggttggaattttataatttgctgtagcataagttcgacatttttaccgccaactaatgcaagagcttgatattgctccggattctttgcaataacggaaagcgtactggtaccgattgagccggtagaaccgagaatgacaagtttttgtttattattcatactattacaaatttatcaaatatataacaaaaaacgcagtaaaaactgcgttttcgctaaattaatcatattagaaatcaagcaattctttttctttgtcagccaaaatttcatctacttttttcacgaaagtatccgtgatcttctggatttcatcttgtgctttacgctcttcatcttcactgatttctttatcttttagtaaggctttaatttgatcatttgcatcacgacgcacattacggatcgcaattttaccttgctcaccttcgcctttcacgattttaattaaatcacgacgacgctcctccgttaatggcggaagaggaactcggatagttgttccagcagaagacgggtttaaacctaaatcagatgttaaaatcgctttttctaccgcactaatcaaagaacggtcaaatactgttactgccaaagtacgtgcatcttcagccactacgtttgcaagctgacgtaaaggtgtcggtgaaccgtaatattccacttgaataccatctaacaaactaggctgtgcacgacctgtacgaattttagcaatatgtgctcttaatgtttcaaggcttttttccatacgctgttgcgtatcttttttaatttcgttaatcacaataattcctttaaaaataataagataagtttaaaatctttgttaatttactactaatcgcaaattaacgtcccttctgttttacctaaaatgacattgtgtaatgcacccgttttgctcatgttgaatacacgaattggcatattatggtcacgagcaagtgtaaatgcggctaaatccataacttgtaattctttttctatcacttcagcataagataatttgtggtaaagcactgcgttgggatttttcacgggatcgcaatcataaacaccgtcaactttggtcgctttcaacacaacatcagcctcaatttcaattcctcgcaaacaagctgctgaatctgtagtaaaaaatggactgccggttccggcagagaaaatgactacccgtttttcacataacatttttatggcttccgaccagttgtatgtatcacaaatcccattcagttggaaagctgacattaatttggcatttacattggcacggtgcaacgcatcacgcattgccaaaccgttcatcactgttgcaagcattcccatgtgatcaccaacaacccgattcatacctgctttagctaacttggcaccacgaaataagttgcctccgccaagaacaactccaacctcgacacccaaccccaataaccctttgatttccagtgccattctatccaagatagacggatcaataccaaaaccctcgtcgccttgcaacgcttctccacttagtttaagtagaatgcgtttataaattggttggctcatttccttacccctttcaataacccagagacaaaatctcgcttattatagttcaacctgactagcgtgcaagtattcattgaaaaatacccctaattattttaaaccggttttaagtcaggattaatcttgaacgctaatttatttacacttggatactgacgttggatcaattgcaataaaggcgattgctgaaagaggaaagcttgtcgtacagttgcattaacgacttcaatccacatagtgtcagattcaaaattgataacacgataaaaccccttgaactcaataggaaataaatgttgtatttgttcatttaattcatctaacaacgaggctttatgaatcattttcatcaatggagaaagttccaataactcattgaaattgatcggtttgctgtatctcatcttgattttccaagttttaacctaatattttatgtagaattatgacattgtaacgaatttccgttacaatacgcagaaatttttgtggtgatgtaaaacgatgatttcaattaaaggtaaacaatatttttggtcgcaactgctattcagtgttatagcgatttttactttgccttttacacaaaattcggatctacaaaacatcaccaacaattatccgaaagaacaaagagtaattcagcaactttcccgtaaaatatcgaacattcaacaggttcagcaacaacaattacaacaaattcgtcatcttgttactgaaccgtcaattcctttccaaattgcaccgctctttttagttcagcaattgagctatcaagcaccaattcgtgccggtccgcaaccaattcaaatttaaatttatttcagtgcccaatattattaggcgaatttgtttatttaatttaaaaagaaaaatactatgttaagaactattgttacaaaaatctttggcagtcgtaatgaccgcattttacgtcgtttagctaaacaagttaaaattatcaataaattagagcctgaatttgagcgcttaaccgatgaagaattaaaatccaaaacaactgaatttcgtgcaagattgaaaaatggagaaaaactggaaaatttaattccagaggcatttgcaaccgtgcgtgaagctagtaaacgtattttaggcatgcgtcctttcgatgtgcaattaattggcggtatggtgttaaacaatcgatgtattgcagaaatgcgtacaggtgaaggaaaaaccttaactgcaaccttaccttgttacttaaatgccttaacgggaaaaggtgttcatgttgttaccgtaaatgattacttggctcgccgtgatgcggaaaccaatcgccccttattcgaatttttaggtatgactgtaggcattaatgttccggggttatcaccggaggaaaaacgtgccgcctatgcagcagatattacttacgcaacaaatagtgaattaggctttgattatttgcgggataatcttgcacattcagctcaagatcgctttcaaaaacacttacattatgctttagtagatgaagtggattctattttaattgatgaagcccgtacgccgttaattatttccggtccggctgaagacagttccgagttgtatatggcaatggataaactgattccaatccttatccaacaagataaagaagatactgaagaatatcaaggtgatggggactttacactggatctgaaaaataaacaggctcatttaaccgaacgtggacaagaaaaaattgagcaatggttaatggaaaaaggttttattaatgaaaatgaaagcctctactcccctgctcgtatttctttattgcatcatatttacgctgccctacgagcacacaaactatttgagcgtgacgtagattacattgtaaaaaacggtgaaattgttattgttgatgaacacaccggtcgtacaatggctggtcgtcgctggtctgatggcttacatcaggcaattgaagcaaaagaaggcgttcaaattcaaggagaaaaccaaaccgttgcttccatcacttatcaaaactatttccgtctgtatgaaaaattggcaggtatgacagggacagcggatactgaagcatttgaatttcaacaaatttatggtttggaaaccatcgttatcccaaccaataaaccaatgattagagatgatcgcactgatattatgtttgagaacgaaaaatataaatttgatgcgatcatcgaggatattaaagactgtgttgcacgcaatcagccggtattagtaggtacgatctctatcgaaaaatcagagttactttccaatgcactaaacaaagcaggcatcaaacataatgtcctgaatgccaaattccatgctcaagaagctgaaattatcgccaatgcgggatatccaagtgcggtcactattgctaccaatatggcagggcgaggaactgatattgtactgggcggtaactggaaagcggaagtggctaaattaaacgatccaacagaagagcaaattgaggaaattaaagccgcatggcaaattcgtcatgatacagtaaaacaagccggtggattacatattattggaacagaacgtcatgaatcccgccgtatcgacaatcaattgcgtggtcgttcgggtcgtcaaggtgatcccggttcttctcgtttctacttatccttagatgatgctttaatgcgtatttatttaacagaaggtaaattaaacttcatgcgtaaaatgttcacagaaaaaggtgaaggcatggagtcaaaaatgctagcgaaagtgattgctcaagcacaagcaaaagttgaagcacataactttgacggacgtaaaaatctgcttgaatttgatgatgttgcaaatgatcaacgccatgcaatttacgaacaacgtaatgctttactggataatgaagatattgccgaaactattcaggtcattcgccaagatgtcttcaatcatgtcattgatgaatatgtcccgccgcactctttggaagaacaatgggatattcctgcattagaaacccgtttgaagcaagactttgctcttgatttgccgttaagtaaatggctggaggaagacaatactttcaatgaagatgtattacgtgaacgtgttttaacagttgctatttctgaatataaacgcaaagaagaattggtaggtcaggaaactatgcgtaattttgagaaaggcgttatgttacaaactcttgatgaactatggaaagagcatttatcggctatggatcatctacgtcgaggtattcatttacgtggttatgcacaaaaagatccgaaacaagagtacaaaaaagaatctttccaaatgtttactgacatgttagatacattaaaactaagcgtcattactacattaagccgagtacaaattcgtactcaagatgaagtagaaaaagcggaacaggctcgtcaaaaaatagctgagcgtgaaaatgccgcaatgcaataccaaaataatgaaggaacatcatcacttcacgaaaaatcagaacataagataggacgcaacgaatcttgcccttgtggttccggaaaaaaatataagcattgccatggtagcaaagcaaaatattaattaatatggcggtggaaatttccaccgcactttttaggataaaaccatgataaaaccaacaatccaagttgccgctggcattattcgtaacgagtttggacaaatttatctaactcaacgactagagggacaggattttgctcaatcattagagttccccggtggaaaagtggatcaacatgaaacacctgaacaagcactggctcgtgaattagaagaagaaatcggtattcatgttctaagtgcggtgctttttgaacgtttttcttttgaatatccaactaagattattcaatttcatttttatcttgtcgaacaatggattggagaaccgtttggacgagaaggccaagaaggtatgtgggtcgatcaaaatgagcttgatgacagtcaatttcctcctgccaattttaaacttattcaacgattactagcagaaaaatagcgataacaattatcttctcgttatatcagctttataatcgtatacaaacaagagggcatttacaaatttagcattttacgtccgcaataacattcaaaattcttttatctgatataggatatttagtgcctagttgttgagcaaataaactaactcttaattcctcgatcatataaggaatttctttaacttcactcgagtgcggtttagatttcggcagttttgctaaaagttgttggtacgcatgactaacctgttctactctgagcattgcagcacgatcacgattaatatcttgtgctaatttatcaatacgcttatcaattgcctgtaaataacgttgaatatcagacaaacgcccataacctgttttcgttacaaattccggataaataagtccattcatttgtgtttttatatcagcaaaagcaaatgccattgtaaaatccatttttcctttcaggcgttgattgatttcaaaagtcaaggtcaggattttttcaacttgctgtgcaatttccactgtaacctcattcagattttctcgaataaaatcacgcaatctctcaaaatcagtttcattccaaaccaaaccgccaaaatcagcaataagtttatccacggcacaagcaatgcaatcatcaattaaatctaaaactcgtccgaaaggcgtaaaatacaagcctaacttcgatttgttcggcaatttttcatgtaaatatttaatcggcgaaggcacatttaatagcaacaaacgacgtaatccttgctgcatagtaacttgctgttcaagctctgtttcaaatagtttaatgccgactgaatctttttcatcaacaatagcaggataagccttaatgctaaaaccttgttttttctgttcataaaattgcggtagtcgagcgaaattccaaacatgaataccgctttgttcaataccactatctgcaacgcaggaaatacttttttgcactttatcttttaggctaaatttcaattgatctaaatcaaggctttcggcaattttgcctcccttttcatcaatgaccctaaaggtcattcttaagtgcggtggaatctgtgctaaattccattcttcaacttcaatctgaactccgctcatacgacgcaattcatgactaagcgtttctagcaaaggtttgtcggtttgcgttattcgacctaagaaagcactggcatagttaggtgcgggtacaaaattacggcgtaaagatttaggtaaagatttaattaaggcaataactaattcttggcgtaatcccggaatttgccaatcaaatcctttcatttcaacctgatttaatagtggcaatggaatatgcaccgtcacaccatctgcctctataccaggttcaaattgataagttaattttaattttaaattgtcttgataccaaaaattggggaaatctaatgtgttgatattggcattgtcttcgttcatcagaaaagacttttcaaaattcaacaattcaggttcttgttgtgcttttttcttccaccaactatcaaaatgtttttgtgaaacaacatcggtaccaatccgttgatcatagaaatcaaataaagcacgctcatcaactaaaatatcccgacgacgtgttttatgttccaattcttcaatttccttaattaatttttgattggcaaaaaagaatttgtgtcgggtattccaatttccctctactaaagcggattgaataaaaatttctcggctggtaacagcatcaatagcaccataattagcaagcctattagttacaatggggataccataaagactgactttttcatttgcaatcacttgtcctcgagactttgaccatcgaggttctgaataactggatttaaccaaatgtttcgctaacggttcaatccattccggctcaatatctgccattattcttccccaaagtttagaggtttccactaattcggctgctacaacccatttaggttgttttttaaataaaacggaattggggaaaatagaaaaatgtgcatttcttgcccctaaatattgctgtttttcattttctttcaatccaatatgggatagcaatccacttaaaagtgcggtgtgaatttgtgcatattcagcctcatgagaatttatgggcaaccccatttcacgcacggttaaacgaatttgatgataaatatcttgccattcacgaatacgtaaataatttaaatactcttttcgacacaagcgacgaaattgatttttgcttaaaattttctgttgctcttgaatgtaattccacaaatttaaataagctaaaaaatctgattttttatcagcaaaacgacgatgtttatcatccgcagattgttgtttttcttgcggtctttctcgaggatcttgaatagataaggcagcaacaataatcatgagttcatgtaaacaagaaaattgtaccgcacttaataacattttagccaaacgaggatcaacgggtaattgtgctaactgcttaccaatagcggtaagctggcgtttctctccttgcttgttttttttccattcaaatgcctgcaactcctccaagagcttcataccatcttggatatgacgtttatccggggcatcaacaaaaggaaaagcttctatatcatctaaacctaaggcggtcatttgcaaaataaccgatgccaaattggtacgaagaatttcaggatcggtaaattccggacgattattaaaatcatcttccgaatacaaacgaatacaaatcccttcagacacacgcccgcaacgacctttacgctgattagcggaagcttgtgaaattggctcaatcggcaaacgttgtactttagtgcggtagctgtaacgtgagattctcgccgtgccgggatcaataacatattttatacccggtacagttaatgaagtttccgctacattagttgccaacacgatacgctttaaattactcgggtgaaaaattttattttgttcttgtgctgaaagacgagcaaagagcggtaagatttctgtatgttttaaatctaatttttgtaatgcttctgcagtatctctgatttcccgctccccatttaagaaaattaaaatatcaccgactttctctgcctgtagctcatctaccgcatttaaaataccttgtaactgatcttgatcctctgcctccacaattggacgataacgtacttctacagggtaagttctaccggaaacttctataatcggggcatgattaaaatgttgagagaagcgttctacatcaatcgtcgctgaagtaataattacttttaaatcaggacgctgaggcaacagctgttttaaataacctaaaataaaatcattgtttaaactgcgttcatgtgcttcatcaataatgagcatatcatattgatttaaaaaacgatcagattgaatttctgccaataaaattccgtctgtcattaatttaatttgtgtttcatcgctgatttgatcatgaaaacgaactttataacccacgactccaccgagttccatatttaattcttccgcaattcttgcagctacggaacgtgcagcaatgcgacgaggttgagtatgtcctatcaatcccttctgcccaaaacccaattctaaacacatctttggtaattgagtggtttttcctgaaccggtttctccagcaataacgactacttggtgttcccgaataagtttctggatttcagcttttttttgattgaccggcaagttttgtggaaattccattttttgtaccgcactttgtcgttgtaaaaaacgaacttgtgcctgttgaatttgctgttcaatttccactatcaccttgttgatattcgtaggatgtttaagttgattcatgcccttgatacgagcaaacaaacgacgccggtcaatcgacatcatgtcgttaagctgtaccaataatgcctgctgttgtgtgctaaaaacattttttttattattcttcattattcttattttcaaatttagtcaatcatgtaacgctaaaaattatttatccagtttttccaataaacaaagacaaaatccccgctgcaattaacggtccaacaggaacaccccctaaaaatgcgacacccaaaatagtccctactaataaacctgtgagtagcgaaggttgcgtccccattaaattcacaccacgtcctccaaaccatgcaacaagcacacctaccgccatggctaaaaacattttccaatgaataagtgcggtccaattcggcaactgaaccttgcctgaaacgatgggactaagtacgccaatggtaagaataataataccaatattaactccatacttttccgtaaaaggaatatatttggctaaaaatgtttgttgcattaaaagtaaaatagttgcggaaatggttatggagctattattgcctagtacaccaagcaaaataaggctgactaacaataaagcaattgagttaaactgtaacgacattgaaatattcctaacggataattaattctcataaaacggtgctaattatagcaattttctacatgcttgcgactttttcgttatcaataaaaaagacattacagcaattatttaacaacattttaataattaaaaaacatctcatttacttaaataaaatttaaaaaataaacaatatattaaatataatttcaatttttagggtaaattttatttttttatattttaaaataattctatttgacctttcaattatttttgggtatatctaccccatcaaataaatttgtcatctttttaagtgaggatcttatgccccaaaaatactcaacgctaaaaaataacataaatatgttaggtcactttttaggcgaaacaatcagcgatgcacagggtagtgatattcttgatttgattgaaaatattcgtgtattatctcgcgactctcgttccggtgatgaaaaagcacgggaaaaattattagatacgctttcgactatttccaatgaaaatattattccagtagctcgtgcttttagtcaatttttgaatttaaccaatatagcggaacaataccaaacaatctcacgaaaacacatagaccaagttgcctccgatcgttctttagaggcactctttgaacgcttaaaagcacaaaatgtaccggcagaaaaagtcatctcaacagtagaaaaattattaattgaattagttttaaccgcccatccgacagaagttacccgccgttctcttttacataaatatgtagaaattaaccgctgtttaagccgtttggaacacgatgatcttactcaatcagaaagcacaaaattaaaacgccgtttaatgcaattaattgcacttgcttggcatacaaatgaaatccgtacgcaacgccctactcctgttgatgaagcaaaatgggggatagcggtaatcgaaaacagcttatggaaagccgtgcctgatttttgtcgtcaattgaatctctatttagagaaaaattttggtgtacaacattcagtaaacttagcacctgttaaattttcttcttggatagggggagatcgtgatggtaatccatttgttaccgcagagacaactcgccaagttttaatcatgaaccgctggaaagcggcagaattgtttttagcggatattcaagttttatcagaggaactttctgtagttcattgcactgaggaattccgtgccaaatacggtgatcatttagaaccctatcgtgtagtcgttaaaaatttgcgagcaaaactggtaaaaactgtcgcttattacggtgaaattttagaaaataaaccttcaaccatcaatacaaatgacattttgaccgatgatcaacaactttgggaaccgctttacgattgttatcaatctttacatcaatgcggtatgcgaattattgctaacggtatattgctggattgtttacgtcgtattcgttgctttggtctctctttgtctcatttggatattcgtcaagaaagccttcgtcatactaaggctctctctgaaattactcgttatattggtttaggcgactattcacaatggatggaagatgataaacaagcttttttaatccgtgaattaagctctcgtcgtcctttgctacctcgcaactggacgccttctccggaaacgcaagaaattttagaaacttgtcgagttattgcacaacaacctgaaggcgttatatcttgctatattatttctatggctcgcactgcctcagatgtgcttgcagttcacttattattaaaagaagctggcgtaacctattatttaccagtagttcctctttttgaaaccctagatgacctcaatgcttctaaagaagttatgactcaattatttaatgtaggctggtatcgtggtgtgatcaacaataaacaaatggtcatgattggttattccgatagtgcgaaagatgcaggtatgatggctgcttcttgggcacagtatcgagcacaagaacaactggtaaatctttgcgaaaaaatgggagtagaattaaccttgttccatggtcgtggtggtactattggacgtggaggtgcacctgctcatgccgcacttctatctcagccaccccgctcattgaaaaatggtctacgtgtaacagaacagggagaaatgatccgttttaaactgggtctacctgcagttgcagtaaatagctttgatctttatgccagtgcaattttagaagccaacctgcttccacctccggagcctaaagaaagctggcgtgcaattatgaatgaattatccgattcatcatgtaatatatatcgtagcgttgtacgtggagataaagattttgtaccttatttccgttccgccacacctgaacaagaattatctaagttacctctaggctctcgcccatccaaacgtaatccgaacggtggggtagaaagtttacgtgcaattccttggatcttcgcttggatgcaaaatcgcttaatgttaccggcttggttaggtgcaagtgcgtctattcgccaatcaattgaaaaaggcaataaagaaactattgaagaaatgtgtaaaaattggccgtttttctctacccgtatcggtatgttggaaatggtgttcagcaaaactgatacgtggttatctgagcattatgatctgaacttggttaaaaaagaattatggtatttaggtcaatctttgcgtgaacaactgcaagccgatattaaaactattctttctttatctcatgaagatgaattaatgtctgatttaccttggattgcagaatccattgccttacgtaatatctataccgatccgctcaacttactacaagtagaactgttgcgacgtttacgtgaaaaccctgaaaatccaaatcctgatgtggaacaagcattaatgattacgattacaggtatcgctgcaggtatgcgtaatactggttagtgatgaactcatcatacaaaagtgcggttaaaatcaccgcacttttttctacttctcacttttgtgctatgattatttcacttttacttatgagaaaatacgatgacagaccaaattaataaattagatcctgatacagcaattgatattgcttatgatatttttctcgaaatggcgggagaaaatcttgatcctgccgatattattttatttaacttacaatttgaagatcatggcggagttgaatttgttgaaacagccgatgactgggaacaagagattggcgttctcatcgatcctgatgaatacgctgaagtttgggttggcttggtcaatgaacaagacgaaatgaatgatatttttgctaagtttttaatttcccacaaagaggaagaccgagaatatcacgttgtgtggaaaaaataatccaagctcaaaattgaggaaaatttgcagttcaatagcctcttcgtataattgctgaacttccagttttgctatttaatacaaatcctagaatattactatttcaaataagaagagcggagaattccgctcttttagccttaaaatgcgttgtgattagttgaacatggcggaaatagattcttcattactaatacggcgaattgactctgccagcatacctgataatgttaatactcgcactttgcccaatgccttaatttccggcgtaaatggaatagtatcagttacaacaatttcatctaatgcttcattcgctagattttttgccgctgctccggagaatacggcatgagttgcataagcaaatacacgttttgctccccgctcttttaatgcttccgccgctttgcataaagttccgcccgtatcaatcatatcatcaactaaaatacaatcacgtccggcgacatctccaataatgtgcatgacttgggctacattggcttttggacgacgtttgtcaataatcgccatatctgtatcattcagcaattttgcgatagcacgggcacgaacgacaccgccaatatccggagaaacaacgatcggattttccaaatctgttttctttaacatatcatgaataagcaccggtgaaccgaatacattatctaccggtacatcaaaaaatccttggatttgttcagcgtgcagatcacaagttaacacacgatctactcctacgctcgataggaaatctgctaccacttttgcagtaattggtacacgggctgagcgtacacgacgatcttgacgagcatatccaaaataaggaataactgcggtaatacgacccgccgatgcacgtcttagtgcgtcaaccataacgactaattccatgagattatcatttgtaggtgcacaggtagattgaataataaatacatcacaaccacgtacattttcattaatttgaacttgaatttctccgtcactgaaacgaccaacagttgcatcacctaaggaaatatataggcgttcggaaatttgttttgccagttcaggtgttgcattaccggcgaaaagtttaatgtcaggcatcgtaaatttaacctctggaatttgtattgttaggaagacaaagtgtttgtttttgttgcgataaatattcaatcatttgatgtaatggtgaaatatttgttccctgagcaacaaaaccaacgtatttttcaggtttatcaagaaatgcagattgtgccgcctgttcgttagcaaattcagcgaaaacacaagctccagttcctgttaatcttgccggtgcatattgtaacaaccagccaagggcttcttcaacctctgaataatgatttaaaacaactttttcgcaatcgttttcatattttgttgttaataattccgctaaaggtcgttttggggtattgcgaggtaagttaggatctttaaatataatagctgtagaaatagatgtttcgggttttaatactaaaaaccatttttgtggcggttgacaaaaagtaagtttttcaccaacaccttcggcaaaagcggcttttccatatacaaaaacaggcacatcagcaccgagctgtaatcctatttcagcaagtgttgagagtgaaagttgtgtattccataaatagttgagtgcaacgagtgctgtggctgcatttgatgaccctccgccaacccctccgcctattggcaaaattttatctaaatgtaaatttgcccctaatgtacaccctgttttttgttgtaataatttagcggctcgatagattaaattatcctcgttttttagatgaggtatttcgggtgttaagattatttttccgtcagtgcgtatctcaatacttaaccaatcgccaaaatttaaaaattgaaataaggtttgcagttcatggtaaccatcggggcgttgagaagttatatataaaaacaaatttatctttgcagggcaaggaaaacgtaatttttttccttgtatttgcgatgataaaagtgcggtcgaaaattgatagtttttcattaatatttccaattatctatcctaacttttaaggtctgctcactacttttcagaagaatatctttgggtaatggaatgctttgatctgttcgatagttgagatagtcagcactccaaacttcaccctcaactgaataagtaaagcttgctaataaatgatttatgccgacctgataatctgaattttcatctggttgaccttttagccagttccctatttgttgtaatggaatagagataccaatcatttcacggagcaagttgttgatatcttttgttgaacgctgatttcctttatggtctgaaacagtaataccgaaaggtgaaacttcaaatttaagcattgaactgctgaaagctgatgaaagtagtaaagaataggattgcggattgttatattgccaagtaaagcgagtggaaaaacgttgtttattgttaatataacccaattgtccttgagcttgatagtgttttatttgcttaattttttgtaggtgttgttgccattttttatcatttttttctatatactgaataccttgcgggcgttcgctggcaatatctaaagtacaagcactcagcaatatcgttaaaataagtataaaaaaaggtttttgagatgttttcatgtgtcggactcgtaaaaatatcgaatattttaaggtcttacataagattagtaaagatacaaaaacttttgattttttgaccgcactttgatctgtttattaaaagatgttaatttaaatttatttgaagggtggcttacttcaatttttacaatgatctctttttaaagaaacacaatgaaaaaatcatttatctcaattgcggcgttagacttattgggagcggtttgggttggtacttcttggtatacaggtaaagtagcagaacaggaatacaagacacacttagaacaggttaaatcgaaattacccgcaagtccgaacccgatagctcatctacatgctaagatcaatgatttacaatttaatggtcgttcttttactgatgaagatattaaacatgtaataatgaacagcggaattggggataaattaggtttacagtaaattgtaggttggctgatttttatactctcccaattttttctcaacaaaggggattatggagaaattttaacattgaaactcattgcccaaagcaagttgtttggaaataactttatacataatggtgattatagttgctatttttttgaagacgaacaataatagtgtgccgataagcaagaacaaatgatttttgcgaggatattttttgataaactacgatatggttatttttccgtatcgtagttttgttttacttaaaaaggaagtgtacaacaatgaaacaaattccaatgactgtacgtggtgcggaacaattaagagaagaattagattttttgaaaaatgtgcgtcgtccggaaattatcaaggcaatttcagaagcacgtgaacatggcgatttaaaagaaaatgcggaatatcatgcagcacgtgaacagcaaggcttttgcgaagggcgtattcaagaaattgaaggtaaattagcaaattgccaaattattgatgtaacaaaattacctaataatggtaaagtgatttttggtgcaacggtcgttttgttaaatattgataccgacgaagaagtcacttaccgaatcgttggagatgatgaggcggatattaaatcgggtttaatttctgttaattcgcctattgctcgcggtttaatcggcaaggacgttgatgatactgttgtcattacaacacctggcggtaaagttgaatttgaaatcgttgaagtagaatataaataacataacactttgataggaaaaaaatgggcttaatgcccattttatttgtttcagttattggcgaggtaactgaattttgggttcattacttggacgataaagtacaagaacatgccctatagtttgtaccgcactggcttgcgtttcacgtataattgcctcaataatcagctgttttgtttcacgttcagcaccagaaattttcactttgatcaattcgtggtgatttaatgcgttgtcaatttcagctaaaaccccttctgttaaaccatttgtgcccagcataaccaccggatttaaatgatgtgctaaaccttttaaaaattgtttttgttttgttgataatgtcattggttacccatcctacataattaaaagtgcggtcaatttgataacaatatttcaattgcctttatctcgaagattttaaccataaatccaaaaaataaaaagaaggaatagttattttataggatagttaaaacactttccggcggtcgtcctattttagctttatctccatttactacgattggacgttcgagcaatgcggaattttgtgagagtgcaatcaaaagttgttgttccgttagctcctgactattcaatcctaattgtaaataaagatcgtctttcgtacgcatcatctcccttacagacgtaattcccaatttttgagctaacgtttgcaactcttcaacgttgtaagtttgctgtagatataattcaacgtcaataagaatggattgttgttccaataaagccaatgtttcacgactttttgaacaacgtggattatgataaattttaaccgtcataaatgctcctttgctcagatacagttcaaatatgcaaaattttaccttataatcacccaaaatgctcattcgttaaggataaattatgattgaaatgttaaaaaattggtatcatcgtcgctttaccgatccgcaggcgatggcacttttcgctattttattctttggatttgtggcaatttattttttcaatagtttattggctcccctcctgattgcgattgttttagcttatttacttgaatatcccgttcgcttattacatgaaaaactgaaactacctagaattttggcgacatctcttatactcggtggctttatagcaatcacatttgtcatgacatttattttgatcccggtactctgggcacaaaccatcaaactggtcagcgacttaccacacatgttcaatcaacttaacgaatggttactttctttaccggagaattatcctgaattagtagattatcaaatgatagatgcgttttttatttcatttaaaaataaaatattaggcttaggtgaatctgcacttaaactgtccattgcctccttgttaaatcttgttaccttaggaatttacgcttttcttgtgccattaatggtatttttcctcctcaaagataaaacggaattaattaactatattacaaactttctgccaaagaaccgcactcttgcctcaaaagtttggcgagaaatgcaacaacaaattgccaattatattcgcggtaaattacttgagattttaatcatagctttagtcagttatgccatttttctattttttggtttgaattattcattgttactggcagttgccgtgggattatctgttttagtgccatacattggtgcagttctggtcactattcctgttgctttagttgccatgttccaattcggtgcaaccccaactttttggtatttaatggttgcttatgtgataagccaaatccttgacggaaatttactcgtgccatttttattttctgaagcagtgaatttacaccctctcactattattatcgccgttcttatttttgggggattatggggtttctggggaattttctttgcaattccattggcaacactagtcaaagccgttgtttcatcttggccgtcaacagaataaccgataaggaagagtttcattgaaagggctatttattaggattgttttatccatctgtttatcgctttgggcaatagatatggttttcccttggcaacaaatagtgagatcaaaacagaattaccatactacaattcaagagcgacaaaaattgattgtaggaacaatcaataatccggtgtcttattttatcggtacaaacggagaaacagggctagaatatgaattaagcaaggcttttgcaaattacttaaatgttgatttagaaatgtttcctctaaatagtgcggacgcattatttcaggctttagcacaaggtaaaatagacattgccgctgcaagtttattttatcaacaagatagaagtgaaaaattcaaactaggtccggcatatcacgctgcatcttggcaattgacttatcgcaaaggtgaacgtcgtcctatcacattagaaaatttatccggcaaattggttattccggctaattcggcactgaataatattctgctggcaaaaaaagaaaaatacccttctttaacatgggaaaccagtgaactaagccaagaggaactcttatttcaagttgctgaaggaaaaatagattacacaatcgctacctctactgaagtatcagttaatcagcaaattaaacctcaaattgcaattgcctttaatgtgactgatgagtttacagtacattggtacttatctgataaggggtcttcagaattacaagccgcactattagacttcatgaactctgccattgaaaacggcttaattgctcgtattgaagaaaaatatttcaatcacctcaaccaatttgactatgttgatactcgctcctatttgaatgcaattgaaacagttttgcctaaatatgctcctttgtttgaaaaatataaaggtgatttagattggcgtttattggcagccatatcttatcaagaatcccattggaatccggaagcaacctcaccaaccggagtacgcggtatgatgatgttgacaaaagcaactgcagatagaatgaatattactaatcgtctcgatcctgaacaaagcattaaagccggttccgaatatttacatcttctgctcaaacaaatgccggatactattttaaaagaagatcgtatttggtttgcacttgccgcttataacatgggattgggacatttattagacgttagacgcttaaccaaacagctgggaggaaatccggataattggttagaggtgaaaaaaaatttacccttattagcacaaaaacgttattttacccatcttaaatatggctacgctcgaggctacgaagcgtttcaatatgtggaaaatattagaagatatatgaacagcataatgaattattatcggcttcaacaaaaccaacaagatcggtatgaaaatgaaaataatgatgtcatttcaatacaaacacaacaggaacaactatgagaagaaaaacctttttaaaaaaaagtaaagtcacgctatatcgtaccgcacataaccgagcattaagaattaaacgcttaaaaaaacgtaaagcccaacaagcagcacgacatgcccagcaattcgtcatacaagaaatttgttgctgatttttcgtgctgtaaaatcatatcctttagcatatggatataagaccaatcagataaaaaagcggaatttccaccgccctttttgctttacataacacaccctaccaaaaccggatcgttaaattctgttttacagtagcccttaattaacaaaatattcaaggcaagagaaaagagaaaagaaaaagaaaaagaaaaagaaaaagagaaaagagaaataaaaaatgattgccttattaataaattttgtaatagaatctccgaaatttattactatccgcttgacaaacaaaaataacatgaatttacagcctacagcctacagcctaggctaacgccttgttgcaaatcttgcaaaataaattttaaaaagtttttaacytytmawmatayccmaatttycccttttmaaccyctyggcgaaaatatcattcgtctttttytgctttgccttaaaaagcaaggcatcgccgatttatacctcattaatctacctaaaaaacaaaaagtttaatccattcacaaccataaaaaagtgaaaaaaaatcaacaaaataaattattaaataacccattttaaaagattaaagagaataaaccatgaacaaaatcttcaaaaccaaatacgatgtaacaacaggtcaatgtaaagccgtgtccgagttggcgagcaatcgccaaatagcaagtagctcggagaaaaagccaaagtgcggtgctaatttgaaaagaacgagcttgtcagaaaacttactgttcaacatgctgatcagcggtttggtgttgtttgcgtatcccgcttgggcagcagcggctcaaactcaagttaacaatgataaagacatcaaaatagatggtaataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctcaacgagtagtgctcggtaataaagcctatgccatcggtaaccaagcggtggggattggtggtgatgtattcgcccaaggctattcctccatcgccatcgggagcgatgatatcggcgaaacggctgatgagaaacaaaaagatggaagtggaaatgataaatactccaaatacgccgtccccctacctaaagccatctggcagttgtttgttgatgagggagatcattttaattcaaaaacgaaaaatagctatgcggttttgcaaaatggtaatagtgacggtaccaacggcaaagccaaaaagagttcagagttttatagcaatgggaatggtagtggaaaaatcgacagaaataaagaccctgctaaatgggaagaagaatatgcaaaatttaataaagacgcatatgaaaaatacgtcaatggcacccaaaacggtagtagcaataaccccaaaaacgtctactcccacacttgggcgaaagggcgtggggcgattgccatcggggcaaggtctatcgcttacggcgaccattctaacgccatagggacacttgctattgccaagggtaactactcttccgcctttgggacgggaaccatcgcctttgaagatggcggtatcgccgtggggaacaatgcgtacgtttatcgcgaacattccattggggtgggaaataacgtccaagcaatacaaaaaggctcgatggttttcggggtcaattcctatgctggtggtagcggttccttagcgttaggggaatatacctttgcgaatgtcaccatggacgatgagtttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaacaatattacaaagccaaaacaaaactacaacaaggaacaggcgaaaagaaagctgaacaatccaaagacagcaaaggcacttataaccaaggtgggatagccatcgggtcgtactctgtcgccttgggggacaatgcacttgctttaggaagacacgcctacgccaaagaagacagcacggttgccatcgggaacttcgcctttgcaaaagatgaaaacgccttcgccctcggcaaagccgcccgatctatgggtaaaaattcattggcgataggtgtggaagcggagatttggagtccagatgcggttgcaattggcacaggctctaaagtgcaaaaaaatgccgaaggtgcggtcgcaattggacaaagtgcgacagtggcaatgggtgccggcgattctattgcgattggtaaaaattctaaggcgggagagaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcgattaacggcggacagttgtatagcgtgattgaaacatttggtaaactcggcacagatattcttggtgcggaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaacttggcgacacattaacattcaaaggcgatgacaagtatatcaaggcgactgtagaaggtgatgctattaaatacagcgtagaagtggcaactaaaatagatgatgattcaacctcatctagttcaggtggagcaggarcaggaacaccagatccmaatgataaattagtgaccgcaagtgcggtgaaaaattatgtcacgacaaaatttggtgcattaagttcaacgttgaatttagaaaccgatcaaccaactgatggcagcaaaaataaaggttcaatcaatttaaaaagtgataccttaaaaattactggcgatagtaatatcacgacttcatttgtgtctaatggtaaaaagaacatcagtataaaacttaaagaaaatttaactaacatttcttccataggtaaaggtactaatggtaccaaaatcacatttgatgatagcaaaaaagaaatcaaacttggctctgtttctgtaagtgtaaatagtgagcataaaatagtaatcggtgagggttcaaaatcagattcacaacatacacttgccatagggaataaagccataataggtcaaaatgcaaaaggctctatctctatagccagtctaacaaatggtgagcaggggaatatatcaaacgccgaatgggcggtgtctatcggtaataaaaacagcatcaccggcggaaatgacattgtcgccttggggtcgaatattaatgtaagcggttctgatggtaagagtaagtctgtagttgcaataggtaatgggacacaagtaacaaatgggaaagaatcaatagcaattggcgtagcaggcaataccaaaatagaaagtgctgaatgggcggtcgctattggtaataacaccaaagtatctggcggaaacgacatactagcattgggttctaatatttcaataactggaagtaataatggaagtgtagtcgtactaggtaatggtgcaaaagctagtgccgcagaaaacagtgtggttataggtaaaggagcagaatcaaaagcccaaagtgcggtggttattggggaaggtgcaacggttgaaggtgatgctggcgattctgttgcattaggtaaaaattctaaggcgaaaactaaaaaacttgctccgagtggattagatggtaatgtcggaactaattcattaaaaatcagttggactgctggggtttctagtggtgcaaatgataaaaaatcagtattcagcattggagatgcaaatagcgaaagaataataaccaacgtcgccgcagggacagtagataatagttcaactgatgccatcaatggcggtcaattaaaaagcgtcattgatgtgtttggtaagttagcatttgatgttctcggagcggaaaaagaaacagagaaagaggcagataaacaaacagttaaagacggatttaaaaaatcaacatttactgctgttcaatataagagagacccacaaccacaaggacaaccacaaggacaaccacagcaacaagcaaaagtaccaatgacattcagagaagcgattaatgaaagcattgctgctattaacaagggcttgatattcaaaggcgatatgccaagtgcggtaacaaatggtactcaaaacacaccgcactatctyggttcgacyattmakattgtgcgtttggcaacgcctgcgaacactggcacaacgactacacagccagctacaactacgccagccatcacrgcgtatagtggggagaatttaatcacgcaatatagcaatactrrtggcaacgccaaaatcgaaatcggktttaaaaaygcaccgacatttagcaaagtaatgcttgctaaagaacaaacatataatggcggaagtggaactggcggaagtacagattggaaaaaagaactcatcactaaaggctaccttgaacaagcgttagataagtttaagtttaaagtatctactggcgagggtgatgataagacttttgaaatcggtcgtggcgatacgttgaagtttackrstggtcaaaatattcaattgactttagcgaagcaagatggggcaacgtctggtagtagtgcaacagcaccagccgctgcaccatcaccatcgccagctccatcaatagcaagcggttcgtcaagcgatgtaagttcaaatagcggtggttcaaatggtatggcttcgtcaggtggtgcaaatggcggtggttcaggcgatgcaagcatggctacgacgggaactgctccaagcacgccaaccagcacaacaagcgatacgagtacaccaaccgctactacaccaacaacggcagtgttaaacattgccacaactagcgatttaagcaatatcagctcgatttcctcaccgcctaaaggagcgaatgcaggtacaggcggaagcggaagtgcgggcggaaattcaggtactggttcaaatgaagaagtcgccaaacttaccttagaagccgagaaaggggcgactttccaagtgggtagcactggtgcgaaagtgaatatcaatgacaagggtatttcacttacgccacaaggagcaaatagcacaggaggatcaagtggagcanatccatctgayncaccatcaatcactattaaagcaggkgcaaaaccggcggatccaaaaagtttagattcacttgatcctaataacggaccttcaatagagttctcagccaagaaaacaagtgatggtaaaaccattggctcaggcaaaatcaccggtcttgctgatattaagtcagatgaaaaagacggcaccgttgcaaccaacaaaaattatgttgatggcaaagtggaagatctgaacaataaccgtccatttgatttttatttagrcaaggaaaaagtcgtgaaagrwaaagayggmaawttccayaaagcarrcraacctamyraammacttkmwgmcgawgawrygaaaaaagtygtkatcaaagccgaaccaagcaccgcacctattgggattagcaatgtggcgagtgggttgggattgcctgcccctgaaaaagatgaggaagaaaagaaaaaggcacagcaaaaaaacactgagctaacaaaagctgttgaggaaacagtgaaagtaatcggtgataaagctaaagaactttcaactactgctcaaaaagtaacagatttaactttagcagccagcggtttggaaatggcgatgaatgcaatgcctgagggcgaagaaaaaatgaaacttcaaactcaattggaagaaaataagaaaaagctagaaaaagccaaagaagatctaggaaaagcaaaaactgctttaaccgaggcacaaaaaggcttaacaaaagccaatgctgactatgaagccaactacaagggttatgaaaaagtcgctgccttagtcagtgccgatagtaaagccgaattaaccaacgtagccacaatcggtgatttgcaggcggtagcgaaatcgggcttgaaatttaaaggcaatgatgacatggaaattcacacagcattaagcggtacttttgcgattaaaggtgaagaaggtgcgaatggcaataaatttaacagcgaccgcactgctgccggtaatatcaaagtggaaatgtctcaagatggcaaagggcttgaagtcaaactgtccgatcagttgaaaaatatgacctcttttgagacacgtgaagtggaggggagaaaatctacgctaaacagcaatggtttgatagtggtcaataaaggtgcagataacaaagtcaaatcagcaacatacggtgcggaagcgatggtgttgtcgaatcaagaaaacggcaataaagccgtggtgaccgctggcggtgtccattttgccactacccaagccccagcgacaggggctcgtgcggggacaggcgtgattacaggcttaaaagacctagacgcacgctcgacaggcgacatggcaaccaacaaaaactacgtggacgaaaaagttggttccgccgtcaatcgcttggataatgcgatcagtaccactaacagacgcttgcaggcgggtatcgctggagcattggctacaggaggattgccgataacggtgatgccaggtaaatctatgttggcagcgtcggctggctcgtataaggggcaaagtgcagtggcattaggctattctcgcatgagtgataacggcaagataatgctacgcctacaaggtacaagcacttcaacgggcgatgtcggcggttcggttggtgtaggctatcaatggtagggttctaaacgccagcaaaactcaccgcacttattgataagtgcggtgggtttggtagggatgattagttaaatctcaccaaaacagtgaacaatgcactgtcccaaatattaaactaatttattctcttatgtctcaggcttaagatctaattttgccatgagcaattgatcgccatcttcttcaggattgactgttaccaataatttgtcaccgtaaaaaatagaattggctcctgccataaaacacattgcctgcatttcttcagacattccttgacgaccggcagataaacgcacatagcttttcggcatggtaattcgagcaacggcaattgtccgcacaaattcagtccaatctaattcttgagcatcggcaagcggcgttccctccacttttaccagctgatttattggtacggattcaggctgaggatctaaatttgctagacttgcaattaaacccgcccgctctttgcgagtttcattcataccgacaataccgccacaacatacttttaaacctgctttcctgattttaccaagagtatttaatcgatcatcaaaatctcttgtgccgataatttctttataatgttcaggtgcggtatcaatgttgtgattatagtaatccaatcctgcctcttttaattcttccgccataccgtcttgtaataaaccgaaagtgccacaagtttccaaccccagatcttttaccgctttgataatttcagtaatttttccaatatctttcggcttcggtccacgccaagccgctcccatacaaaaacgccccgcaccacgagatttagctattttcgctttttcgacaatttcctccacacataataattgctgattttgtacgccggtatgataacgtgcagattgtggacaatagctacaatcctcagggcatccgcctgttttaatagacatcaatgtcgaaagctggatcgtttgtggattaaagtgctttcgatgtacctgagccgcttgatacacaagttctaaaaatggtgtttcaaataacgcctcaactttgcatacagaccaatatttaacgcaaggatgcggtgttaaagagggaatgttgatagttgtgattgtcatattcttttccttatataaagtgcggtcaatttcaacgaggaatttccctctctgttgcttgaccattttttatttcaactatgcgatcaattttatctatcacttcgctcagttgatgagtaaccaataataacgttaattgtttttctctacagaacttatcaatcaatgtcaacatttcctgacgtaaatgaggatctaacgctgaaaaaggttcatcaagtaataaaatcggtttatctcgtaacaaacatctcgctagagcaactctctgtcgttgccctcccgacaattctttaggtaaacgtgataaaaaatccgttaaacctaccgcacttgctactttttccagttgtttgatttcttctttgctcaacttcaaatccgctcttaaaccgatagcaatattttgccataccgttaaatgagtaaataaattatgctcttgaaacaaaatggaaacagggcgttgatgtggtgcggtataagtatgattttcaccatttagccggatttccccttgcttaaccggctcaaatcctgcaattaagtttagcaatgtactttttcccgctccgctttcaccaataatagcaatcttttcgcctagacttatatgtaaatcaaagtgcagagaaatattgggataatcaaaaatagtgtttaatttaatcatctttttttattcgttcaattaatataaaaatacatgtacaaaaaacgagtaacagcaatgcagttactgcaccttcgtcagagcgataactacctaattgttgatataacaaataaggcaaggaactaaaatcctgattcccgaataaagctatggcagtaaaatcccctaaggaaatagcacaagccagtgcaaaagcatatttaaatgatgcttttaaattatgccattcaattaaataaaatctattccaaccttgaatagccaaggattgcgatagtttttcgtaatgttgcatattgttgtacatcggtaactttagaacctgtaaaacaaaaggcatggcggttaagccattacatagtacgactaaagcaaataaatgatagtgggagaaatccatttcccttaagcgaataaataaacctactgaaataaccaagacaggaacagccagcaccagcattccgctatttaaaatactctgagataaaaatgaataagacaaatagtgtaaacggcgtgccagtaataataatgaaacggaaaataacatcgctaaaatcgctgataaaggtgcaatagctaacgaataacctaaagcctgccaaagttgtgattgctgccaaatttgccataaactttgtgcttgaaaagcggagaaaacaatatttattaaaggcaagctgatgaacaataaaacgcaattgatataaaaaatttgccagatttgtaccgctcttgactgcttttctaaccaaatatttttactatgcaataacacttgtggcgatttttgccataggctacccaatgcaaacagcacacaacaaaaaattacttgtaacaacgcaaataaagccgacttcgccaaatcaaattcaaataaaacggcttggtaaatagccacttccaatgtagtgtatttaggaccgccgcctaaggtgagaacaatagaaaaactggtgaaacacagcataaaaatcaagccaaaaaccggtaataattgttggcgtaaatagggaaattcaatcaaacgaataaactgccaaccacgaagattcaattgtgatgccagttgcctttgctgagtgggaattgtttggaatgtttgcaaaaacattcttgctgctaaaggaatattaaaaaataaatgtgcaattaaaataccgcttaaaccataaatatggggttgccacgttatgcctaaaaatgttgttaatttaaccagccagccgttatgtccataaactcctgtaataccaaaaattacaactaatgcaggcaacacaaaagttaacgaaaatagcttaagaatcaaagattttgctataaacctttgatagaaaaaggctcgagcgaataataagcccaaaaaaacggaaagtaaggaagataaggtagcctgtccaaaactaaataaaataacttgcttgatgtaatcatctcgtatcagttccgtccatttataatcagtttcaacagtaaaaataccgctcaataccagaccataaaatgaaacaataaataaccacactaccaatccacttaatgagctgattggtaatgtggaaaaataacgccatgcttttaacaaattacttcaccaaacttgcttgccattgattaatccatttttttagttgctcagcagaaatattggaactgtcaaacacatttgttttgagctgatactgttttaaggcatcataatgtggctcaatagggtcagaaatcacagataacatcacattatttttaacgatatgtgtctgtgcttgcggtgaaatcaagtaatccataaataaatcgccacaggcattttctttgtttgctattttggctgctaattcaacttgtaaaacgccgccttcagcaaaatctgtcgcttggtactgatctttttgttcatttaataaatgataaagtggagaggtgctataacttaatactaaatccgcttcaccttttaaaaatgccccataactttccgtccaacctttaccgacagtaacagtatgtttagctaatgtctgccaagctcgatctacctcttgttgtggatacaccaaatttaaccaaatgattaatccccgccccacactgcttgttcgaggatcctgataaataactcgtaaatcctgacgttcaaccagctcttgcaaagattgcggtggatttactaatttagttttatcataaataaaagcataatgcccgaaatcataaggtaaaaaacgtcgatcttgccaagaaatcggtaaagaaagtctatttaaatcaactttatgctcactgaataattcagacttaattgcctcttgtagtaaatgattacttaagcctagtacaatatccgctttggttttcttaccttctaaacgcagacgattgaacaatacacctgaactgtcaaaggacacataatttacccgacattgcggatattgttgctcaaatccttgtttcacctttggacctgctccccaatcggaggaaaaacttttataagtataaacggttaagccttgtgctgatttcgcttccgcttgagcaaaagagcaaatagacatcgcagaaagtgcggtaaaaattagagtggttttgaagttcattacttttctcctgtttgaataaacacagcatgataagtaatattgacttgattggaaaaagaaaggagtaagaccattagtttcctacgtcagtattaactgtatcaggttcacgggtattatctcagctgttatcagcaccccgactaagtcggacaatagtctattatatttttgttgaaaataacaaggaattttctcttaatctttgacttaacttcaagaacttattatgtctaatgtaatgtacaatttttttatcaaacattttccggcacaatacaacgctacactttttcaagaaattcaaaaaaataaacataatcaaaaaactcaacttgagcaagttatggattatgtttatcagatttgtcgttttgcttgctcatatacaaaaaccgaacaccatcctcttattaagagtaaaattagaattttaagcaaaacaaaaacgttcccaattagtaggcaggaagagtttcaagcctgtctaaaaagaaacgttttgaagttatgtcagattaaaagaaattatttaatcaattattttttttgtagttgaccacattaaagaaacgtcttccttcttgctttccggcatagccacttttttgccaaaaggcattcttcaaccaattctcaaactgctgatgagttggaaatgtcatttcaccaaaattcggatcaaagaaagtaacttttgagccgtcaaccgccgcagatacagtgtgagatcctccctcaagattaatggagattttcttaacaccggcagtatcatcgcctgtatccaaaatcgcttttactaatgaggatacatcattttttgatacagttcctgatacttcatcacgacgaacaaaatctgctacttttttctctttcggaacaacaccttgctcttgcaaccaactatctgtcaatttgaattgttgagtcgcactaccgctattaataaactcagtttgaagttttttaatagaatcaatagtttcttttttcaagtgtccttttttaccaccttcataaagggtattaaagaaattctcgtcggttggattaacattttttgcaatccaatgtgcacaagttgattcacacacaccattttgtgtttcaatgtgttttacaatttccttgtaaacttctcctttagattgggcaaacttaaagcttacttctccaccaaactcttcaacggaagaacgtacagcatcaattttgcttttcactttcaaaggctgaaattgatcctgaatgcgttgcaataccgtgcgttgctgttccactaaatctttactgctcaccaaatcactaactggtttcgcttttgcctgttccatttcagtaactgtttcagaaactgtcgcagatctaactgttccggaactcaaagcagccgaattttctaccgcactttctgtcaagtccgtagaagtgcggtcagttttttctaaattctgctcgttatcttccttgcttcctttttttgccaactcttttaaaaactcaactaccacttcactgctcgttgcggatttagttgatgctttcgtttgaggaataatctgcggttcaaactcatcactaaatttggtaaatgccggataacctgcatcaagtaaaattttatttactatgactctcgccatacgtccattaccttctgcaaatgggtgataagcaatcaatcgctgataaactaatgccccaactacactcggctcaatcccttcatttttcgctcgattgataaaatcaaccgtttccgctaattgaatttttgccgcttcgggactagaaaataccgcattttctttggttaaattctcttttttataaagtaaacgaccttctccctcatccggacgtaatccgtgattaagattctcgatcatctgcactgtcaaaggtttgccttgactgttttgtaagaaatcctctattgctgtcttcaactgttctttcaactccggtgtacgttgaatggttttcgatgtcgcagctaaagcttctgtgatttcatttgtttttgttgaaagatcctctataacctttgttttcggtaacgttttcaccaaatcttgaatttctgaaaactcctcaacagaagggcggaatgtgattgccttattaatacgactttctactttcttagctccctcggtgagaatatcatcaaattcaggtaaatgagacatttgcttaactgtcgcttcaggaattgatttcttcgaaatctctcttgcttcatctaaaaatttctcatttttcaatacattactttcaaaattagcatttcgatcatcttctaaagaaattaatccttttaagttcaaattatcttccaaatcttgataattgactttattcgctgtctcatctcccgctacaggtttcgcaccgctcttacttccggtgaaaaattgtttcactcgttggaaaagtgtggttttttctttttctacacccgtagcaccctctgatttctctgccgcttttttatttcctccagcagcatcttttagttctgctggtacagatgacaacggtgcaacttcatttacagaagtctccactttcggaacagatggtaactgaccacctgctttaccttgttccggctgtttaatggtcaaactgtctgcggattgtgtgttttcgacttcactaacatctttagacttcaacgtaacaggcgaagtcgcttgtccgttttgattattcgcacctccctcttgcggagatgattttttacctaattcagtcaaaaactctttcacaacttccgcacttgttgctgatttagccgtagcttttgtttgcggaatgatctgcgtttcaaattcagaactgaatttagtaaacggcggataacctgcatcaagtaaaattttatttactacaactcgagccattcgaccattcccttctgcgaacggatggtacgcaattaatcgctgataaaccaaccccgctaaaacacttggttccacattttgcttgattgcttggttaataaagtccactgtttcatttaactgaatttttgatgcttgcggactggaaaataccgcattttctttagttaaattttcctttttgtaaagcaaacgatcgctaccttcatcaggacgtaatccatgatttaacttttcgatcatctctacagttaactctttgccctgactacttttcaaaaattcttcaatcgcaccttgaacttcttctttcaattttggattacgttgaattgtttttgacgtatctgctaaagcttctgtaatcgctaaagtttgtgcattgagatcatctaccgcacttcctttttgtatatttttcaccaatccctgaatttcattaaattcatcaacagacggcttgaaagttaaggcatcattgatacgtttctctactttcttcgctccctctgttaatatttcatcaaactccggagaattacccatttgtttgattgtagcttcagggatgtatttcttagcaatctctcttgcttctgccaaaaattcaggatttttcaatacattttcttcaaaagaagaaccacgtttatcttctaaagccaataaatttttcagatttaagtcatcttccaaactatcataatttggtttagaagcagtttcctgttcagattttgcctctttagcttgtgatttattcgatttcgcaaagaagaaatcttttactttcgcaaaccaagatttctcatctgattttgcttttggcgatacgccctctgctccttctgattggagtttctgattaccgttattgttgcgattactttcagccaacgcacttcttggtgtacctaatacagctgattgtccattttccgcaactgtttcattgcttaccggatcgctcaaatttgatgggcgtggcggtaattcaggtgccacatcatcttccactctcgcttttacaatcggatttgccgctgccgcttcatcaccttttgctttcgctctcgcaagcccttccggacttttatccaatgttgcataaatcggctcgtttacctctggttttgccgtatttgctcgatcttctttagattttaaccgagcttttaattcattaaccagttcatttacaaccgcattttccgccggtaatgcacgtttcggcgtttgtggctcggaagacaattccgatggaatcggttcaaattcttcaccgttcgactgaccacgtgccgatctcggctgtattgatggagaggtaatttcagcataatctccctctactgccgaacgttctgtacgcaccgctgtttgcgatggttcgtctaacggaattgtctcataatcactaacttgaccttttgcagatctcggttgtaacacctcagcaattgtcgcataaccatcttcaccctctgccgatgtgcgttttacaggtgctgtttcttgtggtgctgtttcttgtggtagtggaatttcctcataatcgctacttccctgctgacgagatgctctcggttgtaacggcgaaagctcaccaattgtagcgtaatctccaccatctaccgcaactttaggcgtagcctccggtattgccggtaaatcacgttttgctttattcgctctatttacaacatcattaatgtcggcataaatatgatctgccgtatcaacttcctgagttaaacggaaatttggaagttccggcagaggatcattcgcactgcgagttttagaggtaatttccgaataaatttcattacctacttcttccactttgcttaacaagcttctcactgtcggtaattccggcaattgatcactcgcagatcttctcacactgccgtacagcggattatccaccatttcaatgttagaagatgcttttggtttggacaatacgctgtaaatacttccaatcgtatcataaacatgatctgccaaatccgccccctgacttaaacgagttctaaactcatttggaagaggtggtaacggatcattcgcattgcgggttctagaagtaatttccgaataagtgccattacctgcttccgtgtcgctattcaacaagtttctcactgtcggtaattccggcaattgatcactcgcagatcttctcacactgtcgtacagcggattatccaccatttcaaggttagaagatgcctgcggtcgggacaaggtactgtaaatgctctcaatagtatctgctagaactttatttctcgtcccttcaccacctaaaaggctgtaaggactatcactttcaccacctaaggttctatttctaaccgcacttccattacctaaaagactgtaaggaccttcaccgatttgttcgtaaatatgttcctctgcggcttttggttttcctaaaagactataaggacctgctgcaatttcatcataaacatttgatctgatacgagaaatatctgaatttgcatcacctaccgtactgtaagtgctatcactttcaccgcctaaagttctatttctaaccgcacttccattacctaaaaggctgtaaggaccttcaccgatttgttcgtaaatatgttcctctgcggcttttggttttcctaaaagactataaggacctgctacaatctcatcataaacatttgatctgatacgagaaatatctgaatttgcatcacctaccgtactgtaagtgctattactttcaccacctaagattctatttctaaccgcacttccattacctaaaagactgtaaggaccttcaccgatttgctcgtaaatatgttcctctgctgcttttgttcttcctaaaagactataaggacctgccgcaatctcatcataaacatttgatctgatacgagaaatatctgaatttgcatcacctactgtgctgtaaagatcatcgctattgttacgtaaggttctacccttgttagcgttgctatcgcctaaaagatcgtaagcaccttcagcactcactttgtcataaactggctcatcgccagatactttcacttttcctaagaggctgtaaatatcatcgctaccgttaggcaattttcttcctttattggcattttgatcgcctaaagtgctgtaaccttcacctacctcatccaaagttcttagtttgcgtacgtcggcattagaaccgtaaagcggattatctaccatttctacaacatcttctgaagaaattctggttgtagtcggctgttcggcatcattatttactgctttgctaaacttagattgtaatttagattttgctttttcacccaactccactaagtctgcaacttcaaaattgaattgtgtacttgcatatacatcatctctcgttacggtcttagctttgcttagatcatcaacaatttcgcccgttacattattatctttaagattgattccggaaataaccgatttttgtaccgcatcgtaatgtttttgctccgcacgcccaccacgtacattaaatgaagatgcaccacgctcgttaatacctacagaaacgccgacagaaccaccatctttatgatgactatcattaagttgttggctcgtaacatttcctgaaacacggaagccactattttcatctttattgatgaaatgagccgctacaagatccaaatctttaatttgtccggtaattctgttcgcaacaatacctgcctgttgattaagaagttttctgttctcaacttcatgagtataacctgccccaaaacttccattcccttttacaagggtagaactggaaagtgcggcaccagccgatgcactaaaatcaatacttctataaagtctatcaaaggaatcttgttttgatacaatattcgttttacctttgatatttaaatctaaatgatccgctttaatatttgaactaatcaaattaagatcttcacctgccgcaatttttagatttttcgctctcagcaagctgttgttatgtgtaacggatttttccgtggtaaaactttcattgccatcaacagaacccgatacgccaccattacagcctccgctcatcacgctacaacctgaatttataccaaatgcaaatttctgacgagattgtctttcagtactttctcttgttgtttcgccatcaagtatatcaacgttacgtttggcttgaagcgttagcttactgttggcatcgctttctacatttttcaactgtagatttccaccatgggctgaaagcgtaatattacctgcaatttttgtgcgtatatcagaggtttccttaaccttatttgtttcgtaattacgctcaaatccaaacttagatgaaccgccaaccaattcgccggtaacaatatttgcaacatcgctaatatgttgcaacgcaactgtaccatcttgcttaacgccacgttgtgcctctacaatttctttcgctacatggctaacagcatctgcaatagctgagtgtccttccgtttcaataccgaatttcaagactgaacgttcagaatcaagatgatattcatctttttgcttattcgatgtaatctcttttgcagaaagttcaaagccttcatcttctttaactttcttatatttgttgaataaatcattggcagatttttctgtcatcaaatcatcaacttcactttgagatagaactttaaatttaggttcctctttctgagctgcgttgtctgttgcatcaggtgcggcttttgccttagcctgttgctcagctttcgcttcatcttcctctaccgcttttcctgtgaacttatgcttgttaatatcaacaccaccgatttccgcttttttcaatacatgtaaaataccatgatcgacctgcaaatcgctgttggtgtgagttaatgatgtttctttttctctcgtttcgctgaaagatccgcccaaagtaaaaccggtgccggtattagatgatgcaccaccaatatttgttttctcgccgttttggctatcacgttcatggcttacagtgaaccctgcaccgctaatatgaccggatgaatattcttgatccaagcgaatgtaacgttccgtctgttgtgcattgcgacctgccttggtgttataatcaccttgtacaactccggtaacaacttttgccttgatcttactgccttcctgattcacatcattttttatagcgaaatgtacgtgatcaaattcggtatttgaaccgacagaaatcgctttttgcgtgctttccttacgatagcccaatatctcgcctttcttagagaaaattctacccttttcaacggaatgctcagttctgtgagtatctgtcgtattaaaattacgagctttcacaaaacctgttttacctttaatatccgatccttttgaattaatatctgaatcttcatctgcttcaaggtgtaaatgtccctctgttctaattgatgcacgttgaacttcaacatcgccgtttccattcacaaaagagcgggcagtattatcaattcctttatgtccaactaagcgagtgctttcctcacttaaaatatcacctctatttttaattttattttcggcttcaatatcaatatttttaccggaaatcgtaccgctgtttagcacatctcttgttttcaaattaatttcattagcacgaataagtgcatcaccaagccctttgaatttttcagcatctcttaatgttttattcgcaaaataaacttgtggtaacagaacctctttattgttgatatttgctttaacataccaaacaatgtcttgtttaagttgattttgttgttcttttgttagtgcttccccaactttcaaacctaactctttagattcaaaataagagttatctattaattttttaaccaactgtgcatcatttacttgatatttcaatgccaaatggttatctactttcttctcaatagattttgtaattaactgatgttctaaatagttatcaccaattaccgctactttcttaccggcatcggtagatgaacctactttatttaagaaatatttagatccaaaatattcatcttggttaatatactgcaatttcgttctgtaaagcggatcggtttccactttaggacgtgtatcatctacctcttttaagaattggtttttcgaaagtgcttcttcaatttgatgatctttcgccagctcttttctgtattcttcaagacgtttttcttcttcaactttcgcttttgcatccgcttgtttttgctcttcttgcttttgtttcgctaaagcctcttgttgtttttcctcttcaattttgccttgtaatttcttctcttccgcaagtttttcggtttcttgctgagcaatttgtttcaattctgcttgtttttcaagtgcacttttctcttggcgtttttcttcctctttataacctgtttctaggtcgctttgtagctgttcatttttggtttttgctcgaagagcttcagcttgacgtttctgctgagattcctttttcaattcttggaattttgggcgtaatttttcttgtaccgtagtaggtaaagtatcaaatcgctcccttgtttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttatctaagaattttccattagtttttaattcatctggatttaataaatcaggctcttctcctgtatgaggttttaatagaaattcgtcttcatcttcaatttcaatatttggatcaactgttttatctaactgtacgctgttatccacaaaaagatttggaatagataacaaatctgacaatgcggataaatcaacattgctattattcagattttcttttccattcacttccgatctaaactctactttacttaagtcgaatttatgttgtcctacagtgatttgttcattttcagaaaatcctccggttgaaccattttctaaagcattcacctctccctgaattcttccggcaagaattttagccttatcatttggacgataatcaaaatgtgcatcttgtttttctttaaatgatttccagcgttctgacaatgccttatgatcactatttcgccaatctgccccaaagacywgcaccatcgctttttggaatgtatccgacttaatctcttttaataagtgcatagcttgcgagttatccgcataataagaactggagcttgttattggttgctcagaaaataatccatcaaaaagatattcaagggaatcaaattttctctctgcattccctgaaagtgcggataaaaagagacgggctcttggctgataattaaatgtaatttcttgtttttgtttgaaaaattcattcaacaaattggcttggtaagccttcatattatttacaactttcgcattttgggcttcgaaagtgtttttaacattaatcacaccatggttagtgagtgttgcctcttgttgactatctcctttcttaccttcgaatttgaaatttccttccgcacggatcaagcctgctttttctactttcacctctgctttttcaaattctattggattaatccataaacgatagtcgttattatgccaaccatgacttgcgatatcagaacggcgataacgggttaatacggaagaatttgttcctttgctgactttgcccgacaattgaacatcattaatcagttcattagcttttacagtaagatcgctcttagcaaaaatattacccaagttgtaaacggtattttctgcatcgagttccattttaccctcagaatgcaatagagaatccgctccattaataatatttccctcagtttctttattatttcctttagcagataaagtcagttgttcacgagcacccaaaatccctttttcattatagatatttcctttttgagcattaatcgtcagcgtttttccgctggctaataatccgttgttaacaacattacctgccgcattaatggtaagttttgcagtagtttgtagttcatcattttcgctaataaccacatttttagcatcaatagtcaactcatctttcgcttttataaaatggttacctttgctgacaaaacttgtaccatctttaaaagttaatttagctttagatttactttcaatggtaccggtattttcaaaaccaacatctaaatcagcaacggtttcttctttaacgtccgccttgcgtttattgtctttatttatagaaacagtaactgtcttacctttggttgtaatatcaagattatcttccgcataaatttcttttttattgactaatttatcggtatcaatttttactgtatgtccgtaaatacgcccttggttagtcaatgtttgagatttaagctcaagatccgttgcaacgacttttgtctcttcatctagcacaagagatttggttacctccacttttacttttttagaggctaacttccctttgttttttaacttggcatcttctgtagttggtgtctctttattattttttaacttaacatcatctgcggttattgtgatagacttatccgccgtaatctcatttgctatagtaattcttttggcgttatttaatgaaatctcatttttggcttgtagtttatcacctaaatcaatatcccctttgttgctttcaattttaatatcgctttcagataaaataataccgtcgtgttttacacccgcaccttgatccgttacgatcaatttaatgcttttaccgtgcatcgcacctgtacttgcaccggtaatggcgacttcttctgtatcggaagtctgactagtactactgtctttttgtacttctaattttgttttgtcatcactctcaatactatatttagtcttacctgtccctgcaataaaggtaatttctgtttccgatgttttgttcttttctttctctttatttttaatcgtacctttctgttcaattttcttcgcaataatatctaagtaaggtaaattatccgttgcaaacccgttgacatctattgttactgttccttgtgtaatgttaaattccatcttactaggatcaataagtttactggtcgttgcaacaaaacgtcctgcgttaatggttttcaccccatttaaggtaattccattttggttggcaataaccaaatcggcttttgtacctaaaatttccaacgcccctttaatttgactaagttctgaacccgttacctgatttaaaataactttcgcttctttgtctgctagattcttattaccttccagataacctactaattcagaacgttgttgatctttattatttttaaacaccgctccgtttggaatattaaatttttggaaacggttatctgaaattcctttatcattcggtttcgcaatatcgataacaatgacgttattttctgttttgtatagtttagtaggatggttattttcagttgtacctgcacctactcctatattttgattcttagtctctaactggataccgtcattaccattttgaatatcagttagctgaggttttttctccgtttttgtcgcttcctctgccgactgtgcaaaattcggtgctgctaccatacttaacagcaatacagaaacgcttttccaatttaagcacaacgcggaagataccggatttaaaaaggtttttacggataaacatacgttggataagcggtagtcttcaatggatccctgccggtcttcctcgtctgttttttctgacacaacaacagaatcagatgaaccactatctacagctgatgtaatacattctgctacaggaactaaacaacctcttgtcttgctgaaaataagcttataacaattcttattcataataccttcctctaaactaaaaaatcaaaacgaaaccgaacctgtgaaataaaaaaccgacttcttgttactttcctcaaaagttcccactccattaataggcttagcataagtcaatgataatgcaagtgattttatttgagctttcacaccgaatgcaaaccccgcaaacgtatctacaacatggtgcggtcgttttgcatgaacttttcctatatcaatacccaaaaaagggttaatgtaagataaataactcttttgagggtaaaaagggatcgtaactgtttgagaaatatagaatccacgatcacctgagcctgccccacctttgaatcctcttaccgtatattcatctccaattgagaactggttctctccatataagctatcaaatccatattgtgcacctaaacgaaattgataactcattcctcgattaaaaaaaacaaacggtctctgccagttaatactgcctgaaaccaatcttaatgttttgtctctatgtgaattatgtgcagaatgatttgcattaaaccaccgcagtccattggaataagagagatcagtgtaaagtttaccatgccccaaattagccacataagataatcctacattcaatttgttattgtgatattttccaatgcgaatatcaccaaagtaactaagacgtcttttaaactcaagttctccatataaagataaaatcacatctttattacgcaataatgtgtgcgataacttaaatgacgcttgctttgtttccccactggatccgtgagtatgaattcctctcaactgtttcttataaccggaatatgataacttaatatccaaagtcgaaaatgagaaaggttgagtataagacaaggaataattttgttgccgatttgcttgacgatccttataaatacgataacccgttgaaaaactccaacggtcattcgttcctaacagatcactccatgagatgcttaatgttgcctgatttcgaccttcggcattacttccttcaccggaattattcaggcttaaactaacctgcggataagaagtgcggtgcctctcaatgctcaaatttgacatacttttctcattcgctgcaatcacattcacctttgctgtcttatttcccgtatttagaatttcgatcagctgatccacgtcgtaaatacgaagtacctttccttttaaattaggcaaaacaaatagcattgctttatctttgaacaaagaagcctgctgttcttccactaaaatatcattcacttttccccaaagtacgataaattccacttcaccgtttttgatctttgaagattttaaaccaatagcactggttacataaccggcattgtacaatacttgtgttagctcttttgtcaacgcaaacaccgtttttgccgataatggttggtttaaataatgttttgttacttcatcaaaatccaaaaagatctcttccccaccaaaatcaatggtgatcttcgtgatcttttgtacatcttttgctgattttaattgctcaactatctgttcttgatttggtcgattatcttccaaaaaccgctgtgctttctcgaaattttgctcaactttttcaaattgttgttgattttttaaacgtgataactcttgaaccaaaggcttagcctctttcgctgcttctcttgcttgcgtaaccaaaggatcttcttgtgcttgcacaactaaaggtgcaacaacaaaagaaactagtaaacagcatgaaaataggatatttatcttgttatatttatattttggcataaaacgccgtccttccactttaattgggacaaattataccatacgctatttagacaactggtaataccagtataaatcattcttagcaatttcatcgtgtctttttcataatttttcataaaaaaatacccctttcctgtgctaaaaagaaaattgattatactatagtttttatactattgaatggaatgaattacgcagtaattactttcttatttttatcttcgttttatcataactgtcattttcattaaataatactaatttcctctttaaatctctccttttttcgagtagattaagagttctcctcaaaaaattaagtaaccataaggaagaacattatgttattaactaacccagtagtaatttccattattgtgttactcgccttaagtcttatgcgaattaatgttgtcatgggattagttatctcagcattagttgccgggctatgtagcgatttaaccattaatgaaacaataaaagcgttcacaggcggtttaggcgggggggctgaagttgcaatgaactatgcaattttaggtgcttttgctattgccatctctaaatcaggtattaccgatctacttgcttttaaagtaattaaacgcttaggtaagtcgccaacaggtaattcaatggctggatttaagtactttattcttgccatactagcgttattctcaatttcttcgcaaaacttattaccagtacacatcgcattcattccaattgttattcctccactcctttcaatttttaataaactaaaagttgatcgtcgtgcggttgcttgcgtattgacatttggattgactgcaacctacatgcttctccctgtcggtttcggtaaaatttttattgatagtgttttagtaaaaaatattaatcaagtaggtgcttcactcggcttaaaaaccagtgtagcagaagtctctttggcaatggcaattccggttatcggtatggttatcggtttattaaccgcagttttcgtcacttatcgtaaacctcgagagtatgtttcagctggtttaaatgctacaactgaagaaatcgaaaagcacattgcaaatattaagcctttccatgtgattgtaagtgcggtcgcaattgtactcactttcgctttacaactgataaccagttcaacaattatcgctggtcttgtcggtctcattattttcgcagtatttggtatttttaaactaaaagaaagcaatgatattttccaacaaggcttaaaattaatggcaatgatcggtttcgtaatgattgccgcttcgggctttgctgcggtaattaatgcaactggcggtgtaacaattttggtggataatttcagccaaggcttgggtgcagaaaataaaggtttagctgcatttcttatgttgcttgtaggtctatttattaccatgggaatcggttcatccttttcaactgtaccaattattacatctatttatgtgccgctttgtctttcctttggattctcaccgttggcaactgttgcaattatcggtgtttctgccgcactgggcgatgctggctcacctgcctcagactcaactttaggtccgacatccggcttaaatatggacggtaaacatgatcatatttgggattctgttgtaccaacattcatccactacaatattccgctcattctttttggttggattgcggcaatgttcctttaataacttactttgagtgcctatggcatggcactcaaattttttaacttatgcaacaatctcctgttattatcttacttaaacaaaaagttgacgagtttttctctcgttattctcatataccttccaagcaaaaaatctatgccaaatttgaccgcactttatttagccaagactttgagagtttgtcgttttacctgaaagaaattcgtcaatgtttaactcaattagaaaaaatcaatgatgataatgtacaaaaatatactttttatagtgaaaaattaaaaggacaatgtaatgctctctcagaggcgttatcacaaacgaatgctaaaacaaacatcaaatttcagcataacgatacaagtctgcaatctgtacaagagcggcgggaaaaacaaagaattgcactgaataaacttcctccaagggagcgtttaagcaaatattatgaagcattacagactttaaacacaaaattagaacgacaacgagattgctttgaagaggctacattattacaggataagcaaacctatagccaacaaatcgcaattacacaacaacgtaaacaacggtgttctgaggctattgaacaactggaagaatatttggctttattagatacaacctcagagaaataacgaaaatataacgaacatatttcacaagtatgcactatttttgtttaaattcttgcattaatcgcttgatctgccgatcattctttttaaatgctcgacaataaggacaaaataataaatgaatattaattgcacatttttgatagaacgctaattttttttcattactcaaagaaatcaattcagtaatttctttacaatttttcatctattttttccctccaaaccaatttttagataaacatgcctgtaactgaagtctagctcgatacaacaatacatgtaaattagacgtagaaatctcacattcctgacaaatttgttcgctatccaattccaaatactctcgcatcataaaaatgcgagcttgctgagctggtaaccgatttaaacaagcatcaaaaataacccaaaactcctctttataagtagcactttgaatatctgaccattcattaggttcaaaatggtttaaatcccaatgtcctttatcgttaaaaaacgcatttggtgcatcttcttcacagatttcagaaatattaatcattcgattacgactatgaattaagtcaataattttattttttaaaatggcaaatatccaagtttttaatgcagatttcccctcaaaagtgcggatattttttaaagcatttgttaatgcctcttgtaccacatcttcagctagatcaagatccttcagttgcaaaactgcaaatttgaccatttgtaagcgaacttcttcaagatccagttgagaaatatgttttgtttcactcacaatcattctccttgacaaaataatgtaagatttttcatcattctctgactatacaaattatacgctaataatataggatttaagaatgaaaaaattaacttctcacgatgttacacctgaagaaattttctaccaacgtcgtaaaattattaaagccttcggattaagtgcggtggcaactgcattaccaacgtttagttttgcacaagaaagtagcgacttgaaagcacttgaatataaaaaatcaacagaatctactttaattttaacccccgaaaataaagtaaccggctacaacaatttctatgaattcggtgtagataaaggttctcctgcacactatgccaaaaaatttcaagtaaacccgtggaaactggaaattgaaggagaagtcgaaaatccttttacgctcaactatgatcagcttttcactcaatttcccttagaagaacgtatttatcgtttccgctgcgtggaggcttgggcgatggttgtgccttggattggttttgaactcaataaattattagaaaaagcaaaaccgacaagtaaagcgaaatatgtggtatttcatactttgtatgatcccgagcaaatgccggggcaaaaaaatcatttctttgggggcggtattaattatccttatattgaggcacttaccctcgccgaagcaatgcactctctcacgttaatgtcggtaggtttgtacggaaaagcattaccaccgcaaaatggagcaccaattcgcttagttgtaccttggaaatatggctttaaaagtattaaatctattgtcaaaattactctatcggaaacacgcccacgcactacttgggaaagccttgcaccgaatgaatatggcttttatgccaatgtaaaccctaaagtagatcaccctcgttggtctcaagcctctgaacgggttattggtgccggcggattattaagtgtaaaacgccagcctacacttatgtttaatggctatgaacaggaagtggcacatttatacaagggattggatttaaggagcaattactaatgttggcattattacgcatcattattcacttgtgctgtttcgccccattggtgtggttacttttcgtgcttttctcaggaaatgaaaccgcacttggttcagatcctatcaaagaaattgagcatttcttgggctatacagctattttgattttctgtgctatgtttttactcagtatcctattgcaactattgaataaaaaccaataccagattttacgtcgtcctcttggtttatgggcatttgtattggcattattgcacgttgccagctatcttttcttggaattaggatttgatttctcattattcataaatgaaattataactcgtccttatctgattttaggcggcattgcttttctcattttgtcagtaatggcaataacatcgttgccccaaataaagcaatggcttggtaaacgttggtttcaaatacaccagcttgcctatatagcaattatctgtgcagcaatccattattattggtcatcaaaaagtgtaactttagcaccgattgtggtaagcctagcagtgattgggatcgttatttggaaatatagtggaaaatatctcttaacatttttgcataaaaaatagacattttattgtataaaactctcctgattttcaccgcacttttccgctaattgaatgatcatttcacacaaaaagcgacaactaagtgtcgctttctacctttaagcaaaccatcctgcttgataggcaataaataataatgtgaatgcagttaaatacactaaaccgattatagaaagccaaaataacccgcctcttatccgatgttcgccctttaatacaagcgaaagatttaaccacgcaaaaataggcgttgaaacaaaagaagcaatcatggcaaattctaacattggaccgacagcattattgaagtagaaaataatcgctaatccggaaagtgcggcaaataatatcgctaaatttaaggttcttaaactactttgttttttatttaaaattaaacgtaaacattccacatttgagcgagaatatccatcaattaccgtaattgttgtaccaaacatacacataaaagcaataaatgcaataagtgcctttgcccattcaccaatagttgaagcatacatattaatcaattgtgcaatatattttccaccaaccatttgaaccgtttcacctgaaccaaattggactagtgcacccagtgcaagaaatacaatggctaaaattgcagtaccaatataaccgacattaaaatcccaaatgccgtcctcataagatatttttgaaatacggcgtttagcgactacccacattgaattgattgcagaaatttcaattggtgcaggcatccagcccatcaatgcaacaataaaagcaagtgcacttagactccatggatttggggcaatataatcttgcgaagcaacgccattaataccattacgcattaatgcaataattacagcagttaatgttgtcaatgttaatgcaatcataatgagtttagataaactatctagcaaacgatattgcccaaataacaaaataaataagctaacgccaataacaatcagactcaatgtaggaaccggaacagaaatcggtaatacaaaagttaaaatcgcagcacaaagcaagcctactgcggcagtattaataaccgttgaaaaaacatttaataggaaaaatacccatagataagatttccctttttggcgataaccttcaagtaacgtattaccgctatctaaagtatattgcacaccaaaacgaaaaaatggatatttaaataaattcgctaaaagaataataatggctaattgccaaccataaatagcacctgcctgtgtcgacgcaataatatgcgaaccgccaacagccgctgaagccattaaaataccaggacccagtgcacttaatttttttgcccaaaaagattgatttacttgttgattttctttcataaaaattcctactaaccatctaacgaattaaaattctaaaatatttaaatataaaaacaagagaaaaataaaaaataaaattctaataaagaagatttataaacaaaaaataattatataaatccaaaatatttaactttactagattttaatgctattttttaaaaaataaaaagaaataaactctagaaattaagaagttagcaaacaaataaaaaacatataaaaagtaaaagcaaagaacacaatttctgtaacaagatgaaaaaccgaaaaataagatggctggggtactaggattcgaacctaggaatgccgagatcaaaacccggtgccttaccgcttggcgataccccaatagatattctaaatctgaattaactaagaagtgcttaagatagtatggctggggtactaggattcgaacctaggaatgccgagatcaaaacccggtgccttaccgcttggcgataccccaccaactaaagatttgcaagctaatgaatggtgcgggacgagggacttgaacccacacacctcgcggcgccagaacctaaatctggtgcgtctaccaatttcgccagtcccgcaaacatggtggctatgacgggattcgaacctgtgaccccaacattatgagtgttgtgctctaaccaactgagctacatagccatattatttgcattaccctcatcggctttgcggggctaattatgctgatatataccttactcgtcaactattttttaatgttttttttgatttcagtgttgttcgcatatagattatacaattcagataaaaagcatcttatgttgtttttaataaccgtttatgattgatgtcgaataatccaacaattatgaatttgtttattccgttcaaaatctaaaggtaaagttttagcagaaatttctaccgcacttaactctaattcttgcaaaccgtctatatccattttaaaacctcgtttattattggaaaaaacgatagttccatttgttcgtaggatacgctttagatttgccattaacttaatatgatcacgttgaacatcccagctatcttccattcttttagaattagaaaatgtgggaggatcaacaaaaatcaaatcgaattgacgatcacatttattcaaccactgcaaacaatctgcttgaattagtttatgctgcttaccttcaatatcatttagcaacaaattctgttctgcccaatttaaataagtatttgacatatctaccgttgttgttgactttgcttgccctaaagcggcatgaaccgttgccgctcctgtataagcaaataagttgagaaaatccttccctgcagccatttctcctaacatcttacgtgtcaaacgatgatctaaaaataaacctgtatctaaataatcagttaaatttacccataattttgtgccatattcatgcacataaaaatactctcccttattagcaagtttttcatattggctagtacctttttgtttttgacgtacttttaaaattaatttattcgtttcaatacctgttaccgataaaatagcacttacagcatccaataaacgctgacgagctttattttcatcaacatttttaggtgccgcatattcttgtactataatatgatccgcatagcgatcaaccgccaaattgtattcaggtaaatcggcatcatataaacgataagcatccagtttttgttgattaacccatttatcaattttcttgatatttttacgtaaacgattagcgaaatcttgtgcaacttgtgtattttccgatacaaaagtcaatgttttttcttgcgaattttcaaccgcactttctacctgtttacgaacagcaatatggtaatttttttggacacaatctaaaggaccgttttttgccttaaattgacgatacgcacgtaaacgtaaacaatccagcaatgcgggttctccactaaaaattgaaacgttccaatctgcaaactctgtttttaattgacgaccgaatacagaatataaagcaattaaagccggagtagtgcctaatctttcaccataaggcggattacaaatcactgttcctatttcttgttcagttggatttttcaatcctgcaacatcaccttgttgccatttaatgagatgtgagacccctgcattttgagcatttttctgtgctttcttcaatactcgatgatccaaatccaagccccaaaagtgcggtgttaattttcgattaaatgcctgctctgcaagctcaactgcctcttgctttactttttcccacacaacttgattatgacctttccaaaaatcaaatccccaatgtaaacgatgtaattgtggtgctatctgagcttccatttgtgctgcttcaatcaataaagtgccggaaccgcacataggatcaacaagaggtgtccctttttcccaaccggaacgtaaaacaattgcagcagctaatgtttctcttaacggtgctttccctgtatcttcacgataacctcgcagatgcaacgcctctccgctcaaatcgagagatacaactaactcatcttgatttaaataggcatgaatacgaatatcgggatactctttatccacatttggacgtgtttttccatgacgctcaaaataatctacaataccgtctttaacacgcattgcaccgaactgagtatggcgaatttctctattagtaccgttaaaatctaccaaaaaagtgactcgttcatcaaaatgagtcaaccaattttgtccaacaatagcagaatataaatctaaatcactataaatttttgttgtaataagcggtaacaaaatccgagaactcaatcttgaccataataaaatgcgatactgcgtttcatcattcgcaataaagtgaactccaccttgtacaactcgacattcttgagcaccaagatccgttaattcaacttttaaaagttcttcaaaaccacgtgacgtagtagcaaaaagttgtttcattctatctctctataaagtaaaaattgggcgaaagcccaattaacattaatgattaaattgcgtgctatgtagctgtttataagcaccatttaaggctaataactcttgatgagaacctcgctctttgatttcaccctgctcaatcactaatatttcatctgctttctcaatagttgataagcggtgtgcaataaccaataccgttctatctttctgcaaagtttccaaagcggcttggattgcacgttccgactctgtatctaaagcagaagttgcttcatctaaaatcaaaaccggcgaatctcgtaataaggctcgagcaatagccaaacgctgacgctgtccgcctgataaactcgcaccgttctcaccaatcactgtatccaaaccattttctaatttttcgataaactccatagcataagccgcttcagccgcttcaataatttgctcacgagtacatttctctgtaactgcataagcaatattgttagcaatagtatcgttaaacaaatgaacttgctgtgaaacaaccgcacaatgttcacgtaaatttgccaaagtataatcttggatattcaccccgtctaaagtaattttaccttgttcaacatcataaaaacgagtaaccaagttggctatagtcgatttacctgaaccagatcgtcccactaatgcaacggttttaccttgcggaatagtgaaagaaatattattcaatgccggatgttcttttccactgtaactgaaagtaacattttcaaaccgcacttcccctttaactgtatctacaacatgtttccctgtatccttttcagtttcgagatctaataatgcaaataaagtctgacaagccgccattccacgctgaaattgtgcatttacgttagttaaagattttagtggtcgcatcatagcaagcattgatgaaaaaacgacagtaaatgaacccgcactgagattttgtgtcatgatttccggtagcgttgccaaaaataaaacggcagcaagtgcaaatgaggctattatttgtacaaccggatcggaaattgcactagctaccataactttcatgcctctacgacgcatattattacttacttgatcaaaacgctcttcttcaattttttgtccgccaaaagctaaaacaactttatggccttttaacatttgttctactgaagaggttaaatctcccatggagttttgtaaattttttcccaattcacgaaatttttttgacactatacgaatgataatcgcgataattggaccaataataaaaagcaccaaagccaattgccagctggtataaaacattaccgtgagtaaagctataatgtaagccccctcacgtacaattgtaactagcgaacctgatgaagaatttgctacttgttcactatcataaacaatacgtgacagtaacctccctaccgaattctgatcaaaaaaagtaacgggcatatacattaaatgcctaaacaatctacgacgcatcaccatcacaactttgcccgaaacccaagctagacaataagttgaaatgaaattggtgaccccacgaacaaatattaacaaaaccaccacaatagccattattctcaagagcgaattgtcaactttaccaaaaccttcatccaacaccggttttaacatttggatgagtgccgcatcagctaaagcattaaataccaatgctgcagcagaagcaattaagcctaatttaaaaggtgctattgttggccatagccgtttaaatgtttgtaatgtagaaagatctttatcttgcatattcatacttctatcgtaaaaaaattgagtggcattatacatttatttaaattacaagccaattaatcctctataccaagggctaaactctgtccttgcggtttgaatttgaatatcttttcctttgaatattaaacgaatttgaccggaaatggccgtattatagaccgcactttcaaccgcatttaagcgtttgacgacatcttgatgcggaaatccccaaggattccaacgtccactggaaattaaagcaattttaggctgaatatgctgtagtaatttctcaccggttgacgttttactaccatgatgtccgacctgtaacacatcaatcttacccaagtcagacaaaattttatattcagtcgccacatcagcatctcccgttaatagtactttatgctgtccatctgaaattatcagcacacaagaatccggattattggctctcatcacaattttacttggcgataaggcttcaatatataacccttgccaatgccatatttttcctttttgacaagtaatatgaggtctattttctggagaattctcgtacttttttaatgagggactgataaactcagcattcggataagcttggaaaatatcttttactccacctgcatgatcattatcatcatgacttaatataactttatcaagaataataccctgtcttcttagataaggaataatctcaatttttgccatactaccatttttccagcttgctcccgtatcatacaaaattccatgttgattttttaccaataaacttgccaatccttgaccaacatctagagtatcaaattgccattgtgtgttttttaatcgcccttgttcatatagcgaaaaaaaccacagacataaaaaaataacaaacatagctgaactgaccaccataccatattgatattttttatgtgaaaaaccgtccgaaaaattcaaccgtatagggtaaaaacttttttttctaacttttctcaataaagataaatcatcgtcggttgaacacttaataatccatttacagcataaggtgaagagcaaagctaatatagctgaaataaaatagctttctgcaagagaaatattgatccactgatttggtaacagctttaacaattgattgatccatatagcaagctgatcagctatattccagctatttaacgcaccttccgtcagtacagcaaaaagaataagtggaactaacaaaaaactgaacaaaggcaacaataataaattagcccaaaatccatttaaggcgataccgttaaaaattaagagttggataggtgtaaaaaaccacaaaagcccaaattgcaaatgaaaaagaccgataaaataccgcacttttttcaaggaagattgtgccaaaggcttttctttccataaaaataaatttagcggtatccattgataccacatgatcaaacagcctaccgctccgattgatagccaaaaactggctgacaataacataaatggattaagtatcagtaaaacacaaataacccgcaaaaatagttgccaaacattataggaaactcgacatatgcgacacaaacaaactataaataaagcgacaatcgcacgaaaagtaggaattgaaaatcccgctaattctgcataacagaatgctaaaaaaagccctaatattaaaggaaaataaggttcaatataacgagtagggaataataattgaatagctcgccctaatgtaaaaccgatgaacatagctaaaccaatatgcaaccctgaaattgcaattaaatgtgcggtattggtttgttgataaagttgccataattccttgtctaaccatgctctttcaccaaaacccaatgcaagcaataaaccttgtgaaactaaataggaagtttgttgtaaagcttgattcagtcgagtagctcgccaagaaaaatcctcaccaattttcaccgcactttttactgtggcataagctgtaatttcttttgctaaataccaggtttgacgatcaaatcctcctatatttaatcgagaagaaatcggacgaatgtgcatatttacttgccaaatttcaccaacttgaacctcttgctcagtacgccaatttaaataaattcgctgtgttggcaaagatgaggtgaattttccttctgcgatcactgcttgatagtctttctgctgaataatttcggctattttaacgttagtttgtacttttttaggtaagcgggtaatatgctcactttgttccaacaagtttaatgcttgataatgaaaaaatcccaacccaagaacaaaaatgaaaaatagctttagaacacagcgaaaaaatactgctttaacaccaatatatcctaacccaagaacaagacataagatcaatatccattgccaattcaataaaaaaatacgaggcgtaattagcaatgtcattgcactcactaaaataacaaaaaggtaatgatcaaggttgaatttcattgataaattgaagattaattaattcttaatctacaatatgaaaaaaatacctataaaaaccaagtcagataaacttatcttggaatacaaatcacaaaatcaacaaaataatagaaaaaaatgaagagttaacataaatttatttgcttatttgagcaacttctgatatttatagcgcctttaaaatcagctgttccattttttggagtttttgaacaatcataaccagtttgcaaagtgctttcttaagttacaatcaattgtaagccacagaatgaataattattaggagatttaaatgtctaagtcatctttaagtttattagtgctcgccggcgttgacccttataaagaaaaaaaaggcgaagaatatatgaacgatgagcaacgttctcatttcagaaaaattttgcaggcttggcaaacacaaattcaggaagagacatctcgtactgtagcacatatgcaagatgaagcttcgaactttccggatcctgctgatcgtgcaacacaggaagaagaatttagtttggagttacgtgcgagagatcgtgaacgtaaattaatgaaaaaaattgaacatacattgaaaaaattagaaacagacgatttcggttattgtgattcctgtggtgtagaaatcggtattcgtcgcttagaagctcgcccgacagcagatctttgtattgattgtaaaacgttagctgaaattcgtgaaaaacaaatgatcggttaaccaattgatcaaatttggataatgtaaaaataaattttggaaacgttttttgatagttggtttgttagcttaaaagaaattttagaacataaatcaattgttagtgttaatacgaataaagtgcggtcttctctgccgcacttttgaatttttataaaaccacaagatattaaaaaaggggtttattattttaaaatttattcaaaatctgttaagaaaaaaaaataaagtagctaaattaccaagctcaaatttgcctctaacagtttctacttcaaaacataaaactatctctcaggaaatgcgaactgagtcgctttttattgcaacaaaacagcgattgatacacaaaaatcaacacaataaatatgttgtcaaggcgtctcaatacggaattatgccacgtatgatcagtcgtaatgcactgtcagttgtagaaaaattacatcgtaatggttatgaagcttatattgttggcggttgtttaagagatttattattaggcaaaaagccaaaagattttgatgttgcaactaatgctaaacctgagcaagttcaagctatctttcaacgacaatgtcgtttagtggggcgtcgtttccgtttagctcatattatgtttggacgtgatattattgaagtggcaacattccgtgcagcacactcggacaatcataatgaacgccaagcaaaacaaaataatgccggtatgctattacgtgacaatgtttatggaactattgaacaagatgccgaacgccgtgattttaccgtcaatgccctttactataatccgcaaaataatacattacgtgattatttcaacggcattgaagacctcaaagccggaaagttacgtttaattggcgatccagttaaacgctaccaagaagatcctgtacgcatgcttcgttctattcgctttatggcaaaactggatatgtttttggataagcctagccaagaacctatcaaaaaaatggctcatttattaaaaaatattcctccggcaagactttttgacgaaagtgtaaaacttttacaagcgggttatggtataaaaacttatcagttgttacgtgaatacggattatttgatcaattatttcccacgcttacaccttatttcaccgataaagcagatagctttgcagaaaaaatgattattaccgctcttacctctacagatgaaagagttgccgataacttaccaattaatcctgccttcttgtttgccgctttcttctggtatccgctaagagagaaagttgaaatactcaaaaatgaaggtagtttcaataatcatgatgcttatgctctagcaagtaatgatattttagatgctttttgtaccgcacttgccgcaccacgtcgtcatacaactgtcatccgagatatttggtttctacagcttcaactgcttaaacgcaccggttctgctccgatgcgagttatggaacatgccaaatttagggcggcatttgatctcctcgttatgcgtgcacaaatagaggggggtgaggcaattgaattggcaacttggtggcatgaatatcaacttagtaaccaagatcaacgtgaaagtttaataaaagaacaacaacgccttaatccgaaaccgaagaagaaattttatcgttcaaaaaaacatcggaaatctacgctatcatcatgaagactgtttatatcgctttaggaagtaaccttgatacgcctatacaacaactaaatctggcactaggttcattagctcaactcaaaagttgtaaattaagtgcggtaagttctttttatcaaagtaaacctcttggtccacaagatcaaccggattacgtgaatgcggttgcttgtttaaaaaccgaattagatcccatagccctattggatcaattacaacatatagaaaaccaacaaggacgagtgcggttacgtcgttggggtgaacgtactttagatttagatattttgttatatggcaatgaaattatccaaaatgaacgcttaacaattcctcattacgatatgaaaaatcgtgaatttgttatcattcctctttatgaaattgcaccacatctcattttacctcatggcgaaaaattagcggatataatgctcaatttcactcatcatcaaatgcaaaaattataaaatttaaggcaaatatcataatatttgccttatttgctgaactaattttcaacttaaacattattgaattttttttcgaaggatttgacgtcgttgactataaattacaataagttttccactcaccattcactgcggtaccaaccacattaaattgattatcaaagacagttaagtttgcaatcttgcccacttcaatcgaacctaatctatcatcaacgccgattgcacgagccggatataaattacacatacgtaaagtttcatctagaggaacttcaacatatttcaccatattttctaccgactctatcatagtgaccgccgcaccgcctaatgtaccattagcgtcatagcattttccatctcgcacatagattgtttttccaacaaattgaaaagattcaatattggctccggcggcggctgtcgcatcagtcacaatacaaagtttatcgcctttcaactttttatccagtttgatattttcaaaactcacatgtaaaccatcggcaataataccgctataaatatcactatctaatactgcaccaacgacacccattgcacgtccggaactaattggcgacatagcattatgtaaatgtgttgcaaaacctgctcctagttgaatagccttttttgcaacttcatagcttgcattgctgtgtcctaaagaaaccaagatcccattttttacaaactcaggaatatgttttgcggttggattttctgctgctaaagtaattttggtaatgacatccgcattatcacataagaaagatttcatctcgggcgtaatttctcgaatatattcatcacgatgcacacctttacgctcaacacttagataaggtccttctaaatgcaaacccaatgcttgattttgatatttttccaaataatctcgcatgacttgcaccgcacttttcatcccttcatcaggtgaagtgataaaagtcggaagatagcttgtcgtaccggagcgtaagttcgtttcttgcataatctctaatgtgcgaacactaatatcttcattaaacattacgcccccacagccatttaactgcaaatcaataaaaccagcggttaaattattaccttttaaatcaatacgttgaatttcattacatagctgtttttcggaaacaatggctgaaattttatcgttttcaaccactactgcatgtccgtacagcacttcttttgccgtatagatcacacaatttataaaggcatatttcattttttcgtccttttaatcaagcacgctatgaatagcacgttgttccagttcagtaaaatacttaaccgtttttacttttaattcttgtgttgccggttcatcacaaacaaaaatagcatgacgatgtaattgcaatgcactaattgtccaaaaatgattaacatttccttcaacaccagcttgtaaagccaaggctttattatgtcctgttaccaacaacataacttcttccgcatctaataaagttgcaactccaatagtaagtgcatatttaggcactttagttacatcattatcaaaaaaacgagaattggcaattaatgtatcttctgttaatgttttaattcgagtacgagaggcaagagaagatgccggctcattaaaggcaatatgcccatcaacccctacaccgcccataaataagttaatcttaccgtaagatttaattttctcttcataacggcgacattcttcatcatgatcatctgtattcccatctaaaatattaatattttgtggctgaatatcgatatgattaaagaaattattatacataaaagaatgataactttcaggatgttctttaggtagacctacatactcatccatattaaaagttacaacatatttaaaactcacttcctccgcttgatacagtttaattaactctttatatgtctgtaatggcgttcctcccgttggtaaacctagtacaaacggacgttctgcagtaggagcgaatgtattaatacggtcaacaatatattttgcagcccatttactgacttgttgtgctgtttttaatggaattaaacgcataaaatcaccttaattatttcaatattgtcatgtacaaaatgaagttttatttcagaaatagaataataaataaaattatacactaaatctaataataattagcctatttcttaaaatagtgatctcaatcacagataaataaccgctacatttggattgttccacattgtgaaacatattattgagcaacattaatggtgtcggtataaaggataatatgaaccttttgatttaccatttttccaacgcttgttgatcggattctcgatgttcaatccaacgtgtaccttggcaagtttgttcctttttccaaaaaggggctttgctttttaaataatccataatgaattcattagcctgataagcatcacctcgatgagctgtgctgacacccactaagacaatttcatcacccgtatttaacaaaccgacacgatgcaccacagcaactcgataaagttgccaacgtttttttgcctcgacaacaatttcctgcaaggctttccctgtcattgccggataatgttccaaatataaaccggaaaccgaatcgcccaaattcatctctcttactttaccgataaaaataaccgcagcacctacgctatgaggctcggttagccattgataaatcgcattttgatcaaaattttgctcttgaacggaaattttaatatctggcatttatcctcccgtaacaggtgggaaaaatgcaatttcatctccggaacgaaccgcactttccaacggtttaagcgtttgattaatcgcaaccaatagcttccctttctctaaagctaatgcccatttatcacctttttggctgagatgttgacgtaactgctctgctgttgcaaattccgctttaacctctaattcatcaacaccgattaattctctcgtttgtgcaaaaaataatacttttaacatctttataaattcacttcttgtctattcagcaataaaatgccctgattttccaccgctcttttcaagtaatctaacctgttcaataacaatgtctttttgtactgctttgcacatatcataaatggtcaatgcagcaatactggcggctgttaatgcttccatttcaacgccggtttttccacttaatttacatatactttcaacacgaacactacttatttcaggaagtgcggtcaaatttacttcaacttttgataataacaatggatggcacaacggaataagttcccaagtacgttttgccgcctgaatgccggcaatacgtgcggtagcaaaaacatcacctttgtgatgttgccctgacaggatcatttccaatgttgccggcgacattcgaacaaacgcttctgctcttgcttcacgaacagtatcctgtttagcagaaacatctaccatgttcgcttcaccttgatgattgatatgtgtaaatgttgtcatatttttcttttagcccccaatacttgcgagatgatttcgtacaccgctatcgccgatatgtaaaaaatgatgttctcttttactttgtaaagccgtaaaaattcgactttttaattggttctgctgctcatcaaattgcaataaatctcgtagatcaattccttcttcaccaaataaacacaagtgtaattttccctttgccgaaactcttagacggttacaacttgtgcaaaaatttttttcataaggcatgatcaatccaatttcgcccttataatcaggatgtgcaaatacctttgccggtccatctgcacgttcttttttctgtatgctccacccttctcttataagtttttccgctaaaatttgacctgataaatggtattgatgaaaaaattgagccatttcgccggtttgcatcaattcaataaatcgcatttgaataggacgctctttgacccacattaaaaattgatcaaactccttatcattgagagatttcattaacactgaattcactttaattttttcataaccaatttcaaaagcacggtcaattcctcgcataatatcgtgaaatttatcaacgccggtaatcgcatgaaacattttaggatcaaggctatccacgctcacattgattgcactgattcccgcttttttccaatcctcaacttgtctagccattttgtagccattagtcgtcaatgcaatattttttattgtttcaatagcacgaatattttcaacaatggacaggaaatctttacgaagagtcggctcaccaccggtaatacgaactttttctgtacctaattgtgcaaaggcattcaccaatcgtttaatttcaaccagattcagaaaactgggttttgtgctttccgctcgatagccatgaggtaaacaatagttacaacgaaaattacacatatccgtgacagataagcgtaaataatagtatttacgttgaaacgcatcaataagatgattttcaataacattatgaatagaaatagatctttgcactagacacctttttaaataagaaaggataagtcgtttccaatattatccctgagcaattatatttgctggcattgtttccttatttttcaacttaggtaaacaagctcggagttatgcgataacgctcgtattttaaagaaatttaactcattagcctagtcttaaatgaatgaaattaaaaaattgtaatttagtacataaatttaagtgataaacattcaccttaagcatttcaatctttataataggtgaaattttatggagagatattatggcaacaattaaagatgtggcaaaaatggctggagtatccacaacaacggtctcccatgtcatcaataaaacacgttttgttgcaaaagaaactgaacaacaagttttgcaagcaataaaaaacctcaactactcaccaagtgcggttgctaggagtttaaaagtcaatacaacaaaatctataggaatgattgttacaacttgtgaaactccctattttgcagaaattattcattccgtggaagagctttgttatcgacaaggttattctctatttctatgcaacacgcaaaataatccggagaaaatcaaaaaccatctcgacatgctggctaaaaaacgtgttgacggcttactcgttatgtgtgctgaatatactcaaaactctcttaatctccttgccgcattcgaagatttgccgatggttgtcatggattggggaccatttaatgaaaatacggatcttatccaagataacagtttctccggtggatatattgcgaccaaatatctgattgataatggtcataaagatattgcgattatttccggagaattaaaaaaaactaccgcagtaatgcgttatcagggatttgaaaaagcaatgcaagaagcaaatctggctatcaatcctgactggatcatggagggcttctttgaaccggaagatggctatgaatgtatgaataaaattcttgtgcaagataaactgccgactgcggtcttttgttgtaacgatgttatggcattgggtgcaatttcagcaattggagaaaaaggtttgaaagtgcctgatgatatttcagttattggttatgataatattcatgcctcacgcttcttttctccccctttaacaacgatacatcaatcaaaatcccgtttaggtgtacaggcaattaacctattgtttaaacggattagtgaaaaggggaaagaacatgaaattatagaaatttatcctgagcttgttattcgcaaatcagtgaaatcgctataaannnnnnnnnnnnnnnnnnnnnnnnnnnnnnnnnnnnnnnnnnnnnnnntttacctattatctaattgaatatgttcaaacaattttttcaccgcattattatctcttaaacgttcagcttgctcgaccaatgttcgagttaagtgcggtgagaaatattgaataaaatcgtacatataatttcttaaaaaaataccatgtttaaacgctatttgtgtcatactcgatctaaataaatggcttgcatcaagtgcaactaaatcattgtcagcctcagtgtgtgccattgatgccattattcctacacctaaccctaaacggacataggttttgataacatcggcatctgtcgctgtgaaaacaatgttaggcaataaccccgcactattaaaagcatagtctaaatcagatccccctgtaaaaccaaaggtataagtcactagaggatattgaccaagtgcttcaattgtcaatttcttacattgtgccaaaggatgttctggtttgacaattactgagcgattccacatataacaaggcaataaaacaacgtcatcaaaaagatattgtgcttctgttgtaattgcaaaatcaacctcaccgaataaaagagcgtcataaatttgcgtaggagaaccttgatgaatatgtaaacttacttccggatattgtttagaaaaacgtctaatgacggaaggtaacatataacgagcctgcgtatttgttgtcgcaatacgtaaaactccacaatttggacgagtatattcattggcaattgctttaatattttgtgttttaactaataattcccttgccacggcgacaattcttgcccctgccggtgttaggcctttaatatgtttaccgttgcgttcaaaaatctctaaacccaactcatcttctaacaacctaacttgtttactgataccgggctgagaagtaaacaatgcgttagccgcatcagtaacattcatattttgattaacaatttcaacaatataacgaaattgctgaattttcatagcaatacctaaaatctcaatgagaaaaaaggtgcgtcaaaacacaccttccatgaaaaatttattgtggataacgagctgcgacttcagataatagagattgcaactctccctgttgaaacatttctaacattatatcacaaccaccaattaattctccctctacccacaattgcgggaaagtaggccaattagcataattcggtaatgccgctcgaatatccggatgttgtaaaatatcaacataaccaaaagggacattacaattaattaatacttcaaccgctcttgcagaaaatccacacgacgggaatttaggcgatcctttcatataaataagaattggattctcactgatttgttttttaattttgtctaaagtttccataatatctcttataaggtaaattcgggctgaattgtagcataatacaataaagccctaaataaatatttagggcttataaaatctactaaaggataacgatattatttgctacctttcactgagatttcaacacgacgatcttctgccaaacatgcgattaatgctttgcgacctttaaccgcatcacatttcataccggttaccggatttgcttcaccgtaaccaaccgcactaatggcatcttgagcaacacctttagagactaaataatttgctacagtatccgcacgacgttgtgataattttaagtttgacgcatcagaaccgatacggtctgtataaccggcaacagaaacttgtgcggtttttaattgtgcgatttcaccataaacaccgtccaatgtttgttgagcttcaggttttaatgtatctttagcgaaggcaaaattcacatctgaatttaagctgaacactttgtttactacttcaggtgccataaccggtttttgaccgaaacggtaagataagccaagtgttactgcaccgatacttggtgtatagtctaagcgttcaccatctttcttacgtgctttaccaacgcctttaacccattgatattccaaacgtaatgccaattccggtaaagaaggtaggctgtattcaacacccgccgcaaaaaccggagaaacttttaaagtgttttttacaccgtctttatcactttctaaatgtttaacatcaacataattagaacgaattaacgccgcacctacacgaccgtaaatatccaagccttctaatacagggtagcttgcttttaagcctaattgcatcccttgagcggtatgtttagcttcttttttctctttacgaccttttgcttgaccgaaatactcagaacccaactctacagcaacatgatcggtaatttggtaaccaccaaaaataccataagctactgaattacgaactgttcctttcttttctgcagaattttcaaattgattaagaccgtcatggaaagatgcccaaccggctttcgcaccggcatagaacgtatttgcttgaggtgccgcttgtacagaagcaacaaaacctgcgatagataatgcaataattgtttttttcatttgaatttcctctatattaattatcaagaaattaagcactacatgtattccgaagatttaaacatctctaggaattaaggtgggattttaacctaattttacaaaaaagataaattttttctctgatttatcttattgaagcctaaaatttaagcaggttttccattttttttgctttaactaagaatgcttttctttcatgacttgccatttgattacttgttcccggtaatttcactgttaacgggttaacaggtctaccgttaatatgaaattcgtaatgtaaatgagcaccggttgaacgtccggtatttcccgataatgctatacgttgtcctctttttaccgattgccccggtttgactaatgagcgacttaaatgcatatagactgtctgatattctttgccatgtctaatcatcatataacgtccggcaccgttagcctgataagcgactttctctactactccatctgccggagcgatgatagtcgtgcctacaggtacagcaaaatcaacccctttgtgcggtcgtatttttcctgtaacgggatgacggcgagcaagattaaaaggagaagacaccctagcttgacgtaataaaggataacgtgcgaaacctttccctaaagtttctccctgacgactataatagcgtccattatttgcttggattgcgtaataactttttccaccggacataatatgtatggcttcgaccttgccttgcccagtcaatttattatctaaatactctctcgaaactaaaacggcaaacttatcccctttttttaacttattaagacttacctgccactgaagtgcggtagttaattgagcaatttgtttactgctcaagcccaaggctttcaaactggcataaaatgatccttctatctgtccttttagaacctcttctttccaaacacttttcttttctaaaatttgacgtttaaactgagattcattaactcgctcataaatacgttcttcacgttcggaaacaagccaatttaaatattccaaatttccatcattatccaatatccaataaatttgttgaccagctttcagattttttaattccggataactcgccatcatttgacgacttatttcctcatccaaccctgaatgttccaatacatctttcaatttatcgccacgaacaactgtatgtgcaaattgatctttaatacgcattgcttgatctgcagcatctaataaactatttaaggcctctttggcattatcaggcaatgatgatatttcattatccaaattaacttgatccgtttcatcatctaaaccgtctaaatcatcataagacaattcactgttatttttttcatttgcaatttgcatatcaacagatgtaggcttctgagaagaaacatcgtttctcaagaacaaccctatacccattagaataaataaaatagctacaaaaaaaacggcaacttttatgtagaatttctttttgcgtctatctctagctaatttaatgtgctgcaccattctaataacaactctataaaatttcagaacttcaataagaccgagaattgtactaaaaattcatttcatttcataaaaaaaattatacacccgcataatttatagacataaataattactacaccttgttaaaataaaaaaaataagctatttttctacttcaattttacctcagacatttgtttattatgcaaattcactctctaaaatatccattaatcgaattaaaaggcgttaatgtaacattcgcacaaaagaatattctaagcgatattaatttaacgatttatcccaattccattatgaccattgtaggaccgaatggaggcggaaaatcaacattactcaaagtactattaaaactgttgccagccacaagcggtgaagttatttatagcaaaaatgtagtcattggttatgttccacaaaacatttatttagacaaaagtttgcctattaccgtagaaaaatttttatctttaagaaaagggacgcataaacaagatataaaagatgctttaacattactttccattggacatttacgtttgaacgctatgcaaaaactgtccggcggtgaaatgcaacgtgttttgctggctagggctattttgaataagcctaatttacttgtattggatgaacctactcaaggagtagatataacaggacaagcagaactttatcaactgataaagcaaactcaacaacaactcaattgtgcaattctcatggtttcccatgatctacatcttgtcatggcagacacaaacgaagttctttgcgttaatcaacacatctgctgtgcaggctctcctgaggcagtatccaatgatccggtttttattcgtttctttggcaatcaattcgcaaaaaatatcgctttctatactcatcaccataatcataaacataatattcatggtgatatttgttgtggtcaagatttccggtctacacaatgtaaacacaaaataaattaaggaataaaaatgcttgaaattctctttcccgcttggctaaccggaatattactctcattcattaccgcacctttaggtgctttcgttgtttggaggaagatggcttatttcggtgatacattggcacactctgccttacttggtgttaccttaggcatttttttacacatcaatccatatgttgctattctaatattaaccgtattattagcgatcttaatggtttggctggaaagtaatacgcaatattccatagatacattattaggtattattgcacatagttgcttatctcttggagttgttaccgttgctttactgcaaaatgttcgtgtagatttaatggcttacttgtttggagatttattggcactgggatttgatgatctctattttattgccatcggagtaagcatcgtattaggaattttaatctttttttggcaacctttattatcaattaccgtcagtcctgaacttgctcaagttgaaggcattaatatcaaaagaatgcagtttctattaatgattttaaccgcacttaccattgcattaagtatgaaatttgtaggtgctttaattattacttcattactgattattccggcggcaacggcaaaacgttttgcaagaagtccggaaatgatggtgattattgctatttttgtgagtatgatttctatcacattaggactaacattatcagcattctatgataccccttccggtccttccgtcgtcatcagctctacactcttatttgtcctttctttattcaaaaaagaaaataattaggtaagctacaataaaaagacgcaaggtaaccaaaataccttacgtctttctttttattattgaaaaattaatttatttccagagagtaggatcaacgcctttacgaagtaattgagggtattgttcaattttaaattcaggatctttacccgctttgagctgttggcggtaatcttttagcaacaacataactatcggtgccaataaaacaatagacacaaggttaattaatgccataatcgccatcaccgtatctgcaaagttccatacaatatttcctgaattgactgcaccaaaatacacaaagaacaacacaattaaacggaaagtgagaataaacaatggtttattgcgaataaaacgaatgttactttctgcataagcgtagtttccgataatagaagaaaatgcaaataacaataggataaaagctaagaaatgtaagccaaattcaccaacatggtactgtaaagcatattgggttaatgaaatgtttttcagttgttcgccaccataattatctgataataaaataatcaccgcagtacaagtacacacaataatagtatctacaaacacacccagcatttggatcaaaccttgacttacagggtgcttaacatctgccgatgctgccgcatttggtgcagaccccatacctgcctcattagagaaaagtcctcgtttaattcccattaacatagctttagaaaaaattgcaccgaacataccgccagccatcgcatcaaaattaaaggcactctgaataatacgacttattactgtcggtaccatttcaatattcatacctaaaataatcaccgcaatgattagataaaacaacgccatcataggaacaatctgagcagaaactttaccaatacgtttcactccaccaaaaataattaaccccgttacgataacgagagttaacccgacatagtgcggttgccatttccaagcattttttgttgcctcaacaatagcattggattgaactgcattaaacgcaaatccgaacgtaaatattaaagcaattgcaaaacatactgccaaccaaggagctttcaatcctcttgtaatataataggcaggtccgccacgaaataacccgtttttatctttaactttaaataactgagccaaagaagattcagcaaatgcactggacattccaatcaacgccgttacccacatccaaaagacagcaccttccccgccaagtgctattgccgttgcaacgcctccgatattacccacacctacacggctggctaaaccagtagtaaatgcctgaaatggcgttaaagattgtccttgaactgcccgtccaaaccacatttcacgcaaactttgtggaaataaacgtaattgaataaagccggttgctaacgtaaaaaacacacctacaccaagtaatgtaatagtcgctaaatcccatagtggtccatcaaatttatcaacaaaccaacttagtgcttgttcaatgtttattattatagttgaaaacataatctacctcccattaaattgaaacgtgagtatttaaatacaaatttaaaaaaaacaaaaacaaaaataattaaaatataaaacaaatattcttcaattagaaaaaatctaatattaaagcgtttaattaaataaaaaacaataaaaggaggttctacttttgaaaaaatactaatctcttgataaaaagagtgccgccgcacctcgtacaccgccggaatcaccaaattttgcttttttaattaacggtactttcgctgtacgcattaaatgctgcggtaatgctttaggtaatgcttcatataaataatcaaagttggacaagcctcctcctaagataatcacatgcggatcaagtgcggtaataatattgccaattgaaatcgcacacagctcaataaaaagttcaacaaatttaaccgcactttcgtctttgtcataaaagcaccgaataatttctttagcggataacgcctttccttgtagatcacgatacaacatttcaaaaccacgaccggataagtaagtatccaagcatgctttattgccacaaccgcattcataaataggtgctttatcccaacctaacaatttcaaggcgtgataattaagttgcaaatgccccaattcgcccgccataccgctttgtccggaatgaactttgccgttaaatactaaaccgccgccaaaaccggtacctagaatcaaacctaatacgacaggatattgctggttatctttatcccaagcctctgacaaggcaaagcaatttgcatcattttccgcccgcacttctctacctaaacgctcagatagatcttttaaaataggtttattgtcagcaacacgaatattagtaatctctgcaataccggtttcctgattaacaaatccgggaacgccgatgccaactgtacctttacaggcaaatttttcatcggctttttgcactaaatgggtaatgacatttaaccattcatcataactgtctttgggtgtatccactctttcggaataacgtttctccaatttttcattaaatacagcaagctcaatttttgtgccaccaatatcaaatccgtaatacataaatcctccaaatataaccaataccaaccgcacttttatatcttgtcaaaaacaaaaatatcttttctttgtaaataagcaaatataatcaaatgcacaaaccaagcgattaaaatagaagccaatagatcaataggataatgcatacctaagcgtaatcgactcactaacattaacaccgcccacacagttacaacaggtactagcaatttaattttagggttgcgatgaccaagtaattgtgcaaaaccaacaactaatagcagccaagttgccgcaaacattgtatgtccggaagggaaagaataacctgtttcattagcatgatgttcgatcagccaatcaggtgcggtctgttttgtctttgtttcttgataatattgatacactatttttttccgctcacggcgtttttgtgcataaaaatcatctgtactcatgtctgaattctgcactatttcttgcacaaaaggacgaggttcagaaaacattgtttttaaaccgctcttaatgccttgagtcaaaataactgaacatgccataatcacaattgcccatattgcctgttttttatcccgaattgcaacgaaataaaataaagcaaatgcaatacaagtgatgattgcataaggtgtgctacccgtttctgttaaaaaatataaaaaataatcaagcgaggcaacttcattaaattgccagtgccaatcaatgaagtaagtaaaaattggtacaacgcaaagtaataaagtatataatgaaaaacgttttaacatcttgataactcataaaatgaacttatataaggctcttgcattttaacattatcaagttataaaaagctaaaaataagtataggtattttattatgtccaaaattcagttagttgctgaagctaaattacccaccgagttcggaattttccgtattgtcggctttgagtttccagatactcaaaaagaacatgttgctcttgtaatgggcgatattaatgatgataaacctgttcttgcacgtatccattcagaatgtttaaccggagacgctttacatagcttaaaatgtgattgcggtttccaactggcgaccgcattacgccaaatcagcgaagcaggacgaggagtattgatttatcatcgtgaagaagggcgtggtattggactaattaataaaattcgagcttacgctttgcaagatcaaggattggatacgattgaggcgaaccttgctttaggttttgctgctgatgaacgcaatttttcggtttgtgccgatatttttgcattactgggggtgaaacaagtacgtctgctcacaaataatccgaataaaattgaaaccatgaaaaaatccggtatcaatattgtggagcgagtgccattgaatgtaggtgaaaaccgctataacacagaatatctagatacgaaagcaaaaaaaatgggacactttattgtgcataataatgaacaacatttaatcacttgtccgcattgccaagaagaaattccgaaaaaataattttcataggttggcattccccaacctatatttttaactaagttgtccaataatttatttttctatttaatctttctcacttaattccggtattatgtagcagttgcacaaagaccaaaattcaatcttgaccgcaataaaatttctgatgcccttaactctcaaaatagcgttaagggcatttcttttgcttaattctaacttattttcccacacattagacaaaatttccttatcgcagacgtaaccaatcctctcaaccttgtaaaaggtaagcaactttcactaatacaaataggaatgtgattttgcgattaaaagttaagctgcaagtaattcctgttcatacttcatcatctcattgagatttttgaagtaggtttgggagatttcttcaggactgaaagcggtcataccaataagctcttgggtacggtgattaccttgccaatagcctacccattctcttaatggtaatacccataaacagcgtttaagaatattattgaacagctcaccattagactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttatccaattattcctagaaaatccatagtaaaggtagcagaataatgtgtaatttttttagtaggttaaaacagcattttcgcaaacatccttgttgctgtgtttcattagcatttttacttctattattactttggttagcagatttacttcttgttcaaatcatcactcctttccgttgtgatatgtggaaaggcaaagagctagaagtttttttaacccccgaagaatggaggaaactatcgggcgttaatgaatcattaaaagatactgagtggatacattatccagctattgagggaaaagcagaaaaagatcctttttttataaagaataagggggtatatcagccagtaatgtattttaatggtgatagacattggctaagtgaggttaatagtaaatacccttacttaaatatatatatcccaaaaagatactagggcataatacatttatcttatacgatcaaaatttaaaaaaaagaatagtccagtataatatcataagaggctatttccgtgatcctttttttggggtatcggggagttttgattgtaataaaaatgctatgtcagatggctcagatctgatagaagattatttaaaataactagagaggtaagatatgtctaatgataatttggcgttgttggctgctgctgcgtatggcgaattctctgaaataaataatattaaggaaattcagaaaaccttaataaaaaaggctgaagtatccgctactcaagctgaaaaatttacagatacttatgaaataatcgctcatcaagcaaacacggctagtggctattcagggactattgttaaaaataaatattttacatagagagatattatgaaaaaaaagattcttgccgtatttttaagtattattacgattatatttatttctacctatccttattcattttggcttagtgaagtagttgttagaatggtgattgctgaatttgaacaaataatatttccaattaaaagaacaaaagttttgaatagcaatggttttaatataaaagaagaaatatgtatcccttataaaagtttttttggtgagtatgcaattaatattgatctaaaagataaatcgctaaaaccatttgagacaaaaagcgttttattaaatgattttgatttttatatatctatatatgatgataaaaaccaattattattttataacagccctcaagacatcagagataagtcgagagaaaaatataattctgtaacactaaatgaatatatttttcctaaatcagggtgttataaggttaatgttgaaagtgtagatgtaaataatagcaagtataaatatttatatttacgtatttttataacacataccattccttaaattaagataaatgtaggtgattattatgaaaaaatatactttagaagttaaaatagcagaaagaggaacctcatataaaggtcatagttcttctgttgctgggcatattttctatgtattagtagatgaacatggcaacagaaaaagttttggctggggaaaaggagagaattcaacactaggtggaatagagaacattactaaaacagatgacatcgattattcagaaacaaatttcggtggctccgatgatgatatgttatacggtggcgacggggcagataccttgcttggtgaaggtggtgatgattatttagatggcggagaaggcgaagatgttgccgagttctcgggtaattttgctgactataaaatcactaaaatgggtgatggcttattaattagcgacaccaaacaaggacgagatggtacggactttttacgcaatattgagaggctgaattttaaagatattacgaactatcaagtaccagtaaccaataattttaagccacaacttccctccttccaagcctaaataactatttaatcccccctcattaaaacctaattaaacatcatttaactttttgtaaaataaactgcgagacagatcacaaatttagcatttagttgtttgctattttgaaaaattccttatactcgctaaagaggtttttataccaaaacttaggaaaatttgatgtcttttattcgtattgtattgtgggtacttttaggctggttcttactttgggctgggaaatggggttattttatatataaagcacatgagtcgtttttgcctgacgtaaatattcctcttaaattacaaaaaggctataaatacgtgtttgaatatatccctccagatgcaagtttaaaagagcaaacatggtcattagagatagagggaataagttttaataaagaatatgaaagtcatctaaaaaacttaatgttaaatgatggtattgaacatataagtaaaattaaagaggggtatctttatccagcaccagtaataaaaactagagtaaaaaatctagaaacagatgaagtgtatgagaatgtattatcttttcaaaacaagaactccagccatgtatgcaatgaaaccctacaaaatatttggtgttatcattatagagctgatgtactcacaggacaacgttggctaagatttttccctaataatagatatttaatagaaattgaagttctttattctgatattagacaagcaaatttaaaatcaaaacttgttctaggtgatgcacatttaaaaaaaacatatcgtttttaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgataccgcacaattccaatatcgtactcgccgccgccgttttaccacaaattcagctaccttaattatccgtttactcaaaacagagccacatcgttattggcgtgttgaagaaattacaaaagaaatccttattgcagataatcaacccaatacccctgtaaatcgtacctatatcaagaacgttcatgcggcaatggataggttgctcaaaaaggggattgtagaacgacagtcagataaagctcataaagtggctttatggcgattaaaaactgagaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcggttacaattgagtgatgctgcgatttatgttcgattttcccttcaatctcaaatgctttaaacattatctcttttgctgacatccattggtttgggtaatgtttaaacacttttgcaatataatcgctagggtgataagcgtatattgaaatcacatttccattaccaatagatttagctttcctcttgataggacttgaaaacgggtcactctgtaatgccactaaggcttgttgtagagttacttgatgctctttcgccttttcaatacattgctcaaagtgagtaatttgttgagcaagttcagcgattttctgccgaataagggtttccccactcattcttgccataaataaaaatccttgtgatgtaaaataaccacaaggattttagtcaaatttagttaattggtctttgtgcaactgctacataataccgcttaattctgtgttaaaatccattttgcatttttaacccgatacaacggttacgaacaaatataggtaagataatgctccctagattaaaaaacattcctcaacttgatcctttagtttctgcctatttggaaaaattaaaaacgcaacattttgaaggtgatatcgcgacaaattatgcagaacgtttaagtttggcaaccgataacagtgtttatcaacaacttccacaagctattttatttcctaaaacaacaaacgatgtggtatgccttacaaagctagctcaacaaaaaaatttccaatctcttacctttacaccaagaggtggcggtacaggaaccaatggtcaagcaattaaccataatatcatcgttgatctttctcgttatatgacaaacatattagaactcaatgtggagcaacggtgggttcgtgtacaagccggtgttgttaaagatcagctcaatcaatttttaaaaccctacgggttgtttttttcaccggaactttctaccagtaatcgagctactattggcggaatgattaatactgatgcttccggacaaggctctctaaaatatggtaaaacttcagatcatgtactaacgctaaaatctgtcttaatgaatggagaaattttagaaacaagtgcggtcaaatctgatgaacttttacaaaatattcagcatttatcatcaacaggacaaaaacttcatcaagaaatctttcaacgctgtcaacaaaaacgctcacaaattctcactgatttgcctcaattaaaccgttttttaaccggctatgatttaaaaaatgtatttaccgaagatcaaagcgaatttaatcttagtcgtattttaaccggatctgaaggttcattagcttttatttgcgaagcggttttagacttaacacctattcctcaataccgcactttaatcaacatcaaatatagctctttcgatgcagcattacgcaatgcacctttcatgctggcggttgaagcattatccgttgaaaccattgatagcaaagtactgaatctagccaaacaagatattatttggcattctgtacatgaattacttacggaagaaaaagaaaacccaattttaggtttaaatatcgttgaatatgcaggaaacgacctcaccttaattcaaaaacaagtatctcacttgtgtcaactgttagacgataaaatagctcaacaacaagacaatattatcggttatcaagtttgctcagatcttccttccatcgaacgaatttatgctatgcgaaaaaaagcggtgggcttattaggtaatagcaaaggcaataaaaaacctattccttttgtggaagacagttgcgtaccgcctaaaaatctagccaactatattagtgagtttcgtcaattattagataaacatcacctagattacggtatgtttggacatgtcgatgcaggtgttctacatgtacgccccgctttagatttatgtaataaagaacaagttttgctattcaaaactatttctgatcaagtagcagatttaacaaaaaaatatggtggcttaatttggggagaacatggaaaaggaatgcgttcacaatacggtgaaaaattctttactccggaattatggcaagaattacgctacattaaatttttattcgatccgaataatcgtttaaatccgggtaaaatttgtaccgcactttattctgaacaagaactctactccattttgtcgccaatgcgggcagatcaagatcgtcaaattcccattcaaatgcgagaggaattttccggtgcgatgaattgtaatggtaacggattatgctttaactttgatgttcacagtgccatgtgtccgtctatgaaagtcagcaaaaaccggctattttcgcccaaagggcgtgcagcaataattcgtgaatggttgcgtttgatggcaaatgaaaatatctcgcctgaacagctgaattttcgtaaagtcgaagtgaaattaacagatcttgtcaaaaaaattcgcaatacggttgcccaaaaacgaggggaatacgatttttctcacgaagttaaagaggctatgaatacttgtttagcctgtaaggcttgtgctacgcaatgtccaattaaaattgatgtgcccagctttcgtgccaagtttttctatttttaccataaccgctatttacgcccattgaaagattatgtagttgcaaatgtagaaatgatggcacctttaatggcaaaagcaccgaaatttttcaacttttttacaacggctaaactcactcaatctttggctgaaaatctgctagggatgactgatttaccctcattgtctgttccctctttgcaacaacagttagttgaaataaattatcaaggttattcattggagcaactggaaaatctaagtgcggtagaaaaacaaaatattttattgattgttcaagatccgtttacctctttttacgatgcaaaagtcgtcgctgattttgtagcactctgtcaaaaattaggttacaaagcgattgttcttccttttaaacctaatggtaaagcaatgcacataaagggattcctagcacgttttgccaaaactgcaaaaaatcaagcggacttcctcaataagataagtaaactcggtttatctctggtcggtgttgatcctgccattgttctttcttatcgtgatgaatataaagaaattctcggtgatgaaagaggagattttaatgttatcactgctcatgagtggttgaaacaagaattaagttcagggaaacttgagcataaacttacacaaattatgcaaaaaaataaccgcacttttaataaagaaagtcaacagaaatggtatttatttccacattgtacggaaagtactacactaccgaacagtgcaaaagaatggcagcaaattttttcagcttttggacaagaattacaaaccaaaaatgttggttgttgcggtatggcaggaacgtttgggcatgaaattcaacacctagagatgtcaaaagaaatttaccatttatcctgggctaaaaaattacaaggaaaaaatcctgattattgtttagctacggggtattcttgtcgcagtcaagttaaacgtatgctccattggcaacctaagcatcctattcaagccctattatcaattatttaaatagaaagaacttgttatgaaaatttggaaaaaaaactacacattagaccagcttaaccaattaaccgccaattgtgccgttgcacatttaggtatagaattcactgctcaaggtgatgattggcttgaagcaactctccccatagatcatagaacaactcaacctatgggatatttacacggcggtatatcctgtgcattagccgaaacagtagggtcagcggcaggtttttgttgtgttgatgaaaatcaagcggtacttggtgcagaaatcaatgcaagccatttacgccctgctacaaaaggaaaagtgacagcgagagcaacaccaattcggataggaaaaaatattcacgtttggcaaatcaatctttacgatgaagaacggaaaatttgttgtagctcaagactaacattaagtgtgatagcaattaattaacaattaaataacgttgctcgttggctattaacaccaatccacaacgcatgatttaccattgacatcacaagataataatttaggaagttatacaatgaaaaaagacaataaaatactcggcgtagtgctaggcatagggcttattttagtggggatatttatattaaacagtcccttattgactttattgacaattatttcgtaccttgcatgggcagttttgctcagggggttattttccctctttaaatgttataaatcacataaaaatacccaaccatttgataaaacagaattagccgccggcatcgtcttaatgattcttggcgtgatattcttaaccaacccttcatttaccaatgcacttgtattttatttagtcgccttttggtttatacttgaggggattgtcggtatatattatgccgccaaacaaaaagaggcggtaaaatggattggtgttgtactgggtgttttactcgtatttttcggcttatccatttcagtagaaccgctaagagccatattggcacttaatctattgctggggttggcagtcgttacaaacggggttcaaattcttgtagctcaactgatgaaagagaaatagagggttaccgaatgaaaaaaatcggcattattcttgccaatttaggcacacctgacgagcctactcctaaagcattatctcgctatttatggcaatttttaacggatccacgtgtagtggatctacctaaatggcgttggtatccgttgctcaaaggcgttattttgccacgtcgatcgactcgagttgcaaaactctatcagtccgtttggactaataaaggctctcctttactcgtcatttccaaccaacaaaagcaaactctacaatcctacttcgatgaacatcggattaatgcgacagtagaaattgccatgacgtatggtaacccgtcaatggaaagcgcggttgaaaaattactggaaaaacaagtaaatgaaatcatattgttacccctttttccgcaatatagcagtacaactaccggtgccgtcttcgatgcctttgctcaggcgttaaaaaagcaacgcaatattgtgccgtttcagttcattcattcatatcatttacatgaagattatattaatgcactggtaaacagtattaagtctaaacataaaccggatgaatacttacttttttcttttcatggcataccgttacgctatgaaaatgaaggagattattatcgtaaacattgtcatgaaacagttttagctgtagtagaacgtttaggcttgcatgaaaatcagtggcaaatgacgttccaatcaagattcggaaaagaagaatggttgcagccttatacggataaagtgttggaaaatatttatcaacgaaatatacaaaaagttgccgtggtttgtcccggattttccgcagattgtttagaaacaatcgaagaaattaatgaagaaaatcgaagaatttttctctctcatgggggagcgtcttttcaatatattcccgcacttaatgcagaaatgcaacatattgaaatgatgtataaattaatctcaagtagattataaaatcaactggtaaaatagagctgtaaaatactctatttacatctaaaaacattaatcttaaaatgccccgtcatcgcataccactgtcagttaaatttgctgatttatctttctaactctcaacgaattaaaggaaattgagatgaaaaaattaactaaaatgactttagctaatctgattttactcggagcgattcaaacagcgaatgccagtgataatactgtgtatctttatacatggagtgaatatgtccctgaaggattattagaaaactttactaaggaaacaggcattaaagttattgcatccagtttagaatccaatgaaacaatgtatgccaagctaaaaacgttggggaaaaacagtggatatgatgttattgcaccgaccagctattttgtgtctaaaatggcaagagaaggcatgttaaaggagttagatcacagtaaacttcctgtaatacaggaacttgatcctaatatgttagatagaccttttgacaaaggtaataaatactctcttccacaactattcggtgcaaccggtattggatacaacgctgacaatcaaaatcccgaacaccttcaatcttggggtgatttatggaaccctgaatttgcaaataaactgcaaatgctagatgacccaagagaactatttaatattgcattactaaaaatgggggaaaatccaaatacccaagatccaaaggtaatagaaaaagcctatcaagaattattaaagctacgtcctaatattttagtttttaactctgataatcccgcaaatacctttattaccggtgaaacagatgtcggcttgatttggaacggatctattcgtgtcgcacaaaatgcaggcgtaccgattaaaattgtttatccaaaagaaggaaccatgttgtggattgataatttagccattccagcaacagctaaaaatgttgaatcggcatacaaactcatcaattacctgttaagtgcggatgtttccgaaaaattaacgctcgaaataggctatcctacttcaaatctcaacgctctcgaacgcttgccaaaagaattaaccgaaaataaaggtatcttcttaccgcaagaagtgcttgatcgaagtcaatggcaagtagatgtaggagaggcggctgaactttatgaaacttattatcaaaaattaaaaaatatgcaataaatacttccccgaaaagaactcatgaatgatccccgtaaactgcggggattttatttatcagataaactatttttaaatatttttactcaccaacttaaatgaagtttaattcgctttatattcttcaatcacaacaggtaaagtcaaggttttatctaaacgctgtatgaccatatttattgtggtattaggtttagtattactaatcgcttccatcatttgagcaggagaaacagcatcaataccatcaaaactaacaatcacatcaccaggctgaataccggctttatgtgcagggctaccttgtaatattgatgtaattaaaattcctttatctcttaaaccctttccattgctaaatagaatatcactttgcacccctaagtaaccacgaataactcgaccatcacgaatgattttttgcataacatcattagctaattcaataggaatggcaaaatttaatccttccgcaatttcgttggcattcttaccaatacttaacgtacttataccaatcaattcaccagcagaattaatgagtgccccaccggaattaccacgattaagaggggcatccgtttgaataaaattttgtcgtccaatgaaatcgccaacagcattacgacccaacgcactaataataccttgcgacacactttgacctaggttatagggattcccaatagataaaacgacatcaccgacatgagcttgacgttttggattttgtggaatggttgccagattatctgcatgaatttttaaaaccgctaaatctgtcaagcgatccgaccctactaacttcgcttcaaaaatacgtccattttgtaatgccaccacaatttgatccgcattttgaacaacatgctcattagtcaatatataaccatcttttgacataataacgccggaacccaagttattaatttgtggctggtagttattggttgtaaatgcaaaagcttgattataaacattaactaccgccggtgaagcaatacgtacagcatctttataagaaagaatatctttttgtataaaaaaaacatttgtcaaatactcatttcccttgaaaacaggcaatataagtaacaccaatgctgcggcagctaacccagtgattattgattgaattaatttttttatcattatgtgattgccctcagtatcataaaatgtgacgctgataattcaacttaatgtcttcgccaatttgtgccaaagataacaattgccactttggtgcatcggctaaacggttcaaatgtggtaagtgacaaaagccacgagctttattacccagtaatttcggtgccatataaataatgagctcattcactaaattttcctcaataaatgcaccggctaaagtttctcccgcttctaaccaaagactattaatctgacgctttgccaattcaatcaacaagttttccaaataagaatgctcgttacttgggaataattttatatattgacaataatcaggaaacgccgaaatatcacgttctttatcgccaaccaaccaaatgggagattgacattgaaataatttatgacgaggtgtcacaagatgctgacgatcaagaataattctgacaggttgacgcacttcttcaactttataattttgttgtaattccgatggaaattgctcccaacgaagatttaacaagggatcatcggctaacaccgtcttagctgttgataaaattgcagaaactttagcccgctcttgctgtacgtcttgccgtgcctgttctccgctaatccatttactctcgccattagccatagcagttcgaccgtcaaggcttattgccattttcaaaataacaaaaggtttctgtgttctcattcgtgttaaaaaacctttgtttaataattccgctttttcttgtaataatcctaccgcactttcaatacctgctgcttgcaacatagctaaccctttgcctgcaacttgcggattaggatctttcattgccacaataacgttgcgaatacctgcttcaattagtccttttgcacaaggaggcgttcttccgaaatgagaacaaggctctaaagtcacataagcagttgccccctttgctctatcaccggcatcacgtaatgccataacttccgcatggggttgccccgctttaaaatgaaaacctctcccaacaatttcaccatttttgactaaaacacagcccacagcaggattaggtgttgtggtaaatatgccttttttcgcaagatctaaagctatctgcataaaatattcatcttgagctgaaaatgttggttgcatcattaatcctttaatttttcaatttcattggtaaattgattaatatcatcaaaactcaaataaaccgaggcaaaacgaatataagcaactttatccaattctttcaattcagccatcactaaacgcccaacatcttgacttttcacatcacgctcacctgttgctcgtaattgataaataatgcgactaattgctttctctacatcatcagaactcacaggtcgtttttctaaagcatgttgaatacctcgacgcaatttatcttcatcaaaaggttcacgtgagccatcatttttgataattttaggcacaataacttccgcactttcaaaagtcgtgaaccgctcatgacaatatccacattctctacggcgacgaacctgataaccatcagaaaccaagcgactatcaatcacctttgtctcctccattgcacaaaaaggacatcgcataaaaaatccttaattaatcaaaaaaaaataaagcttatcttagcaaaatagacgtaacttgacgatatatttacatatcagtcaacaacgaaatgagagttcccttttagatttagaataaattttgacattcattttcttttaagcgtttaatgaaaaacatgttgtaccaaaaccatatacaaaacggtaccgactgcaatggataaaaacatgtttttttgccaaaaatgcagtactaataccacaataccagcaatgaaatcaggtataccacgatgacctgtcgtcagatcaatatttttatagcaatatactaccaacataccgaacatcgctgccggtaatactttgcctaaatagcgaatatattccggtacagggcgattagctggaaaaatccaaaaaggcaaccagcgaaaaagctgtacacctaaaattcccataccaatagtgattaactgctcatgaaaagtcacttatctctccctatctatccaatttagtcgccagtttttgcgataatattgaacggcgtaatgttaaatacaaccaaatgccaatcagtgttggaataagaaaaccctctttccctaccgttaataaagaaatcaatgcgattccgaagccaaataatgaactttcatgagatttttcttttaaccaattttcagcaaaaataactaaaaataaggctgtcattgcaaattcaacaccggcgagatcaaaaggcaaaatagaaccgaatagcgtacctaaagcagcaccaatgatccaatagcaatgtaaatataaactgacaaaaaagaaaaaccagcctctatctatattatgaggaatttttgccatatagtttaaagaaaaagcttcgtcaactaatgtggcaatcaaataccaccgttttttacccaaatctccgctgtatttctccagcattgagatggcgtaaaaaatctgccgcccactgaccattaatgtgattaataaaacgtgccaaggagaaaaagtactaactaatgctcctgcaataataaattctaccgaaccggcataaattaaggttgccattaaaataggataccaagttgcaaatccttgcactttcatatataccccataggctatgcctaaaaacatgaatccggcaagaataggaaaagaatgaggcaaggctacttttgccgcattccatacggtttttgattgattaagatctgacatacaataactattctaaaatagacaatccgggcaaggtagaaaaacgttgagatttaataatctcatagaaatcatcaataaaggcaacatcattatccgtttctcggaaagcaccatagagatcactatataacccttcatcagtaatttttcttgccacaacatagcctctatccaaataaggttttactgcccaaaacggcaatgtcgccacaccacgtttacttgctacaagttgaataatagcaatggttaattcacttgtacgtcgagaaggattgatgcctttaggatgtaaaactttacgtagaagatcgagcatatcatcaggcacagggtaagttatcaaggtttgctcaacaaaatcttctgcttgccaaacctctttccccgccaaaggatgatcctttgcacacaaaccaaccatttcataggaaaacaagggcttatgaataatacccggcgtttcttcaatttctgatactaccgcccaatcggctcgatgactcagcaataaaccaatagcatctgtatggaatccagacacaatatcaagttcaactaaaggccaatgttgacgaaaattatccatggcaggcatcagccaatcaaaacaagtatgacattctacagctatttttaactcgcccgcctctccttgtttaattctcgataaagctcgttcagtctccatgaccttaggcaaaatttcattggctaatttgatcaaccgctctcctgccgctgtaaaccgcaaaggatgacttttccgctcaaataaaggtaattgatattgttcttccaataatttaatttgatgcgaaagtgccgattgagttaaataaactctctttgccgccaaagaaacactccctgtttcttttaacgcaatgagcgtttttaaatgacgcaattcaagaaaaataggtttcatgaagattttgataacaaaaaacaatttgccgtattgtacagcaaaataaaaggatcaaaaaggctttctcctctttgacccttagtcaactacatcaaggtaaaaccaatctttaccctctccacactaagtgcggttagttattgacaaatttttcgcctaattcaatatcagctcgtaaagttggcaacatatcttctaaggctttttgttcaaatgcacttaaggtacccaccggtaaaatttcctctaccccttcttttcctaagcgaacaggttgtgcaaagaaacgagcatatttaccatcaccttcaacatacgtacattccacaacagtttcaccacttagcccctgtaccagtgagagagcaaaacgtgctgctgcttgagccattgaaagtgtagcagaaccgccacccgctttcgcttcaacaacctcagtaccggcattttgaatacgttttgttaatggtgctatttcgtcctctttccattcggtatattgtacttgggataacaatggaagaatcgtcacaccggaatgtccgccaattaccggtaccgcaatgcgtgaaacattgagtcctttcaattcagcaacaaaagtttcagaacgtaatacatctaatgttgttaccccaaataatttacgtttatcataaacgcctgcttttttcagcacttcagcagcaattgctactgttgtattaaccggattggtaataatacccacacaggctttaggacaagttttagcgactttttcaattaaatttttcacaatacctgcattaatattaaataaatctgaacgatccattcccggtttacgagcaacaccggcagaaattagtacaacatcagcgttttctaaagcgggagttggatcttcccctgcaaaaccttgtatcttcaccggtgttggaatatggcttacatcagccgcaacacccggtgtaacaggtgcaatatcatataatgataattctgaacccgcaggtaattgtagttttaataacagagccaatgcttgaccaatccccccagccgcacctaaaacagctattttcataagaacctccttatactcatacagttacaaattgaaccgcacaaattttaaaatgatcaagttcttatttcaaacaaagaaattaaattgtgcgatctacctcaaatttttaacaaaaattatttttaaatattgaaaactaagaatataaatataaaaattatctacctattttgcatttttatgcagcattccccaacgtcgatttaagagagaatacataatgatcaatgaaaaagcagatagcctagtcaacgcttttaaagaactactttcccaagaaagctttggttcccaaagcgaaattgttagtgctttacaacaaatgggatttactcatgttaaccaatcaaaagtctccagaatgttaacaaaatttggagcagtgagaacacgaaatactcgtatggaaatggtatattgtcttcctaatgaattgagtgtacctaataccggtagcccattaaaaaatctcgtgttagatgtagatcataacgaaacattaattgttatcaaaaccagtcctggtgcggcacaactcatcgcaagattactggattcggttggcaaatctgaggggattttaggcacaattgcaggagatgatactattttcgttacccccaccacaggaaatgatattcaggttttaattactaatatccaaaaattattcgaaagttctttataggattgtgatgaggaacataagatgaaaatattcatcacaggtgccactggcttgattggctcaaacttaatccctctcttactggaaaaagagtatcaaattaccgctttagttagggacatggagaaagctcgtcatcagctacctaatcaagttcagttggtcaaagcactgtctcattatgagaatttcaatgattttgatggcgttatcaatcttgccggagccccgatttttgcccaatattggacagccggctataaaaccgaactcattaatagtcgccttaatttaacagaaaatttaaccgcacttattaataacagtaacaaacctccacattgtttcatttccgcttccgcaacaggttattatggcgatcaaggaaataatctcattactgaagaatctctgagcggaaatcaatttaccgctcaattgtgtcaacaatgggaaaatattgctttacaagccaacagcagagtgtgtttattacgcactggaatggtgttttccgaaaaaggcggtgcattaacaaaaattctaccaatttatcgttatggagttggaggaaaactcggtaccggcaaacaattctgggcatggattagcttacaagatatgttacaagctattctgttcttgctagaaaatgcacaatgcgaaggtgcgtttaatctcgttgcaccaaaacctattcaaaataaagatttcaattgccaattaggtgcatggctaaaacgtccttatttcgcaacagttcctaaatttttacttaatttattattaggtgaacgagcgacccttttattagacagtcaaaatgttattccacaaaaattattggaagccggatttcattttagcacaccgacattcagcgattttttacattcgataaagaaataggacatgttatttacaaaaaaaccaccgcacttaataagtgcggtggttttttcttagagtgtagcaagttggctaaattaccactgataccccacrccaaccgaaccgccgacatcgcccgttgaactgcgagtaccttgyaatcgtagcgttattttaccgttatcacttactcgtgaataacctaacgccaccgcactttgtcctttataggaacctgccgaagcagcaaacatggatttacccggcacagaagacatcggcaaacctgaagttgccaaagcacccgcaatccctgctcgcaattctttattggacatatccagtttattgttgagattgctgagtttttggtcngcytgtctttgtaacgtatcyacatatttyttattcaccaccgcactttcaytsgtygwtgsytkratatccggyacggtrataataccgttttcaccatcaatcttaatttcaccgtttgctccggttacggttaagccgtttttattaagaacagcttttggcatttttggattttgctgattttgtgtcgttacgttgtcagcaaaggtaagrctttcagcrgttattgtngctttattgccagttttcttatcttccaacatgatattgtccgcaccatargtkgcmgakwtgtctttgyyrytaccatttttgttgttgacaacwkttaagccmtcgctatttaacgtsgmttttttaycgccmtcctctttggtttcaaaggctttcatatttttcaasgtatccgacagttttatttctaarccrtytttggctgtattggtttctaccttgatattgccagcggcactactaaatgaacttgtagyttgacygttttgagtttcctcttcccctttaatagttaaggtatcgctgattyttctgactacatcatcgccctgatttcctttaaatctcaacccwgcttgtgcaaccgcttttaartcagcgagattrgcsgcttgatgcagrtcttgttgctcagtcattttttgcccttgctggctactyataccgtyrgaaaccagttttttcactagwtcaagggayttaccwtktttttsagawtcmgryttayctttcatactatcattatcaakyccyaarscggatttkagrttkttgatggcaacagggtcatgagccttacctccattttkaggtttaccgcctaaagtgattgattttttatgttcatcatcatatttcaccgctattttatccgcttctgtctgttggtcggtgatggtcttgattttgctgtttacaaagtctttcaccgccttagctgtagtaagttttttgtcctcagcactagaatttccgccagaaccgtccgcacttccattttccttaatttcttcagttgcctctattttgaaggaaattgttccggtgtcggcatcaatactcggtttgatatagtcatcgcctttaaatttaatcgtagccccaagctgacgggtcattttgttggttgatgtaccgccggtttgaggtgcggtcgtagttgctgttgtagtagtaccgttgtccacctcaaaaattaaacctttgttaatggtttcgatgtttttatcaatagcttctttaaatgtcgtnnnnnnnnnnnnnnnnnnnnnnnnnnnnnnnnnnaatgcagtaaatgtagttttcttaaagccatctcctctatcatttttctctgcacccaatacttccgtacccagtttaccgaatacttgaataacgttgtaaagctgtccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaactttcgtttcaatctcatctgttgttcccaaaacctgcaaggcttgactttgaattttaacagcaccttggacttttccgtttgaggattgagattgtccgctagaagacggcgtacttggagccgcactttgagcttgtccaccggcttgtgcttgtgcggtgttggaattatcagcttcaatttttagcgttaatgaattcaattgatttttcaagtattctttaaccgcacttacagtaaccagtttattgtcgttttggtcagttgtactgcctgaatttgtatcactaatagaagtagccactttgagcttaaaggtaattttaccaccgctgttatcaaggctaggcgtaaggtaactatccccaccaaacgttagcgttgagccaagttgacgggttaaaggaccgtttccactcgccattgatgattgagctccaccaccagtttccactgcaaattttagcccctcgttgattttggagatattggcattaattgcatctttaaatgtgtctttagtcgcttgatttccaccacttgtatctttcaatgcagtaaatgtagttttcttaaagccatctcctctatcatttttctctgcacccaatacttccgtacccagttttccgaatacttgaataacgttgtaaagytgtccgccgttaattgcatcrgttgaaccgtcccttacttyacctgcggcgacatgggtgataatgcgttctgagcctgtagaaccaacgctgacgacttcttttttattgccttccattgtatcagcagaagcaccggcgtttttccagctgattgttacttcactttgtcctgtgttttgtgtagttccactaggtgcggtctttttcgtcacaatttgagaatttttacccaacgcaaaggaattrtcgccgttgccattaacattgataatatctaactttttcttcactgactcgccaagtttaatggtaacggttggctggtcttgtttaacttctgttttgatgaaatcgctatcaccttttatttccagttgggctttgtttaactcaactttnnnnnnnnnnnnnnnnnnnnnnnnnnnnnnnnnnnnnnnnnnnnnnnnnnnnnnnnnngtaccaccaacattttggagtttttgggttatgtaggttttcaccgcagtttcagttacaagtttgttgcttnnnnnnnnnnnnnnnnnnnnnnnnnnnnnnnnnnnnnnnnnnnnnnnnnnngttgactccgcttcaaaggaaatttccccttttgaayyatcaaggcttgctttgagatgttgtccagttttgaaagttaccgttgcacccaattgacgggtcatttcrgttgartttccwgcagaaccgmccgcacttgtgccgttttcgactttraatttcaagccctcrttgattttmkcratgtttttggtaatagcgtctttaaatgttgttgaagctggatttgtctcagctccgtttttatctttcaacttagtaaacgtagtttgtttaaaaccggctttgttagtttcggctttttctgcacctaatacgtcggttcctaaatagccgaatacatcgataacgccttttaattgcccaccgttgatcgcatctgtggaaccgtccctaatttcacccgcagcaacatgtctaataactctttcacttcccatatcccctatacttagcacggattttttatcagaatcggatgcagatgttccagcattttcccatttaaataataggctataactgccattaacacttaactcttgtgttttaaatgcttgtttcttatcttctgccttagaacctttacctaaagcaatcgaatcccctgcattagtagatacagtcgcaccttccccaatcgctaccgctccggcagcacttgcttgaacagttgcatctttaccaatcaccaccgcactttcagcttgagaaattgcatgtttaccgataatcactgaatttttggcgtttgttattgtgccattacttccaccgttctcaccatttcctattatgattaaatttgcattttcggaacctatattaagattacttcctattgcaactacattactaccggaacctgttagtgttattttattacccagtgctataccccatgcggaactttctatttttgtttctcctgatacaccaattgcgattgaagcatcactactttccaatacttttgctttataccccaatgctaaagattgttctgatttaacttgagtttccgcacctagggcagttgaccatttagcatttgtaactaatgaactacgaccaatagcgatggcatcgtgtgaaktaccattttctacttttgcactcacaccaatcgcaatggaatttggggcttttgctccgtcgttatcaaaattgttgtttgtgcttgttgttgtggcggaagcggcggtgccatttcttaccgaaatataatgcaatttcgctgcttcaagttgtttaaagtttacggcatcgtcattacccaccccatcagcaacgcctgaaattttgactttactacttccattacttccagtttgtgtaaatgttaaatcagtcccaccgacttttaacgtggcagttgatgtactatttgacccattactaaatgatagaatgttattattgtcttttcctacgctgttaataccttttaaggtgttattaagttctattgttaaattacttccagaagatttagtggtaatatttttatggttgccatttgaactatcttcttttcctttaatatttaaaatgtctcctaattttagagattgttctccgccagtatttccagcaaatttaagtcctttgtttatcgctgtgatggtgtcttcaattgcttctctaaaagtagacttcccagcattagttccatttccattatatgagacagctgtaaaagtagtctttttaaagccatctgttccagtatcggctttttcggcaccgagtacatttatccctaaattagcaaatacatcaattacgctttttaattgtccgccgttgatggcatcggttgagcctgattgcactgttccggcggcgacattcgttattattcgttccttaccgctgtccccaatacttaaaacagacttgtcccctcctgctccggcactactccaagtaatttttaggtcatttgcacctgcattagccgtaagtccagtcggtgcgatctttttcatttccgccttagaatttctccccaacgcaatagaatcsccagcggcggtggatacagacgcactttccccaatcgccaccgcacctgtggcgttggcttgaacattcgcacctttaccgagtaccaccgcactttgtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattattccccaacgccacgatatctgtrccgctgttgattttggttttattaccgatggctaawgaccattcrgcwtkmtytaattyygtatggtcagaaccatytccttcattaaccgcactgatagcgattgagccttttgcattgytgaatgtaacgccgttaccaacagcgacaacggcatcttgtttktytttactgtcttgtgtaaccgtaatayctgagcctaacaacacggaatgttttacatcaacattcaagtccttaccaatyacaatcgcttgttcrgcttttgatttcgcttcgtacccaagrgcgatggcatatttttcggtcgcttccgcacccacgccgatagcgatagcacccwccatctttgcaccatcgttgttgtagttgccttttgtgccactcgaaccgctagaaccrcyacctgcaccgtttgtaccatcattcaccgasarataatgcaaagattgsgtaccagtactgcttccgccacttccgccaccgcttgtaattttgctatttacatagtctttaaccgcttttacagttgttaattttttgtcttcgggattgctgttaccgcctgatgtgctgttaattgaatcagtcgcattgacgccaagcttaattgtgtccttaccattactaccttcagtgsttaaagtcagatagtcgtcgcctttaaagrtcaatgattgtccgagttgtcttttgatagtattgyygttactgctaccgcttccatttcccccaactttaaaggtcattccttggttgatagcattaatagcatcattaattgcgtctttaaacgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatsacrctatataactgcccaccattcaccgcatmggttgakccatcckcmacmttaccagcwgcracatgttttagtaggstttcgtttccaacatctcctactttaataacctgtttattcgcaccagtccctgcatttttccannnnnnnnnnnnnnnnnnnnnnnnnnnnnnnnnnnnnnnnnnnnnnnnnnnnnnnnnnnnaccccctctcgaaaataaatcacttaaccccgyggctttgktgattttttgggttatatcgtcgttgagtttgattttgatggggytacttgaacaattgtgtattmcttgagwgtttrmacymyyaaatccccctcctrctccattrytttgtttmmtacaastaaatgakyytmcatytacmtcgataaaaccytctccctktatccccgttttcatcatattttckacatctytcgcttcaccatcttgtaatcctgwaacaccgggkgaaaaactttgtcccaaaacctcyacyggcaacrccaccgayaacgctaacrccagcggtgcgagtttaaacgcccckaaaacaccgaaaaacmcaccgcacttcggcttactctccgaactgctcgctatttggcgattacttgccaactcggaaacggctttacattgacctgttgtaatatcatatttggttttgaagattttgttcatattctttactcactgtttgtttattcatctgtttttttkggtttttgttgtgtttttatatttatagagcggttataaacctaagcggaaaattgctttgctttttaaggcatagcaaaaaaagacgaatgatattttcgccgaggggttgaaaagggaaaatggggatatttttaaaggttaataatataaaaaataggttgcagggcttgcaacaaggcgttagcctagrctgtagrctgtagrctgtagrctgtagrctgtagactgtagactgtagactgtagactgtagactgtagactgtagactgtagactgtagactgtagactgtagactgtcatttttcctgttctattttatttgtcaagtaaaaattcttgctatcctatcctaaatttttatagaaagaaatgatttttttactttttatcctaacttgattgaggcgaacaattaaaatgtttgatattcaaagaggattaaatcatcaccgcactttttagcataacgaaaaatcctagctccctattgggtaagagttcacatttatatggcacgatcagataaaatggaatgcttaaaagtgcggtacattttacagagatttcatttttctgttgttcttacgctgagaaatagcgataatgtgcgatctagaaaatccattgaagacttatgatagattatattttactgattattagtaccgcactgattaataactttgttctagttaaattcttaggactttgtccgtttatgggcgtttcaaaaaaaattgaaaccgctattggcatgggattagcaacaatgtttgtacttactgttgcctcgttgtgtgcttatttagtcgagcgttatttgcttactccactccatgcaaatttcttacgcaccttgatttttattcttgttatcgctgttgtcgtacaatttactgaaatggtcattcataaaacgagcccaacactttatcgtttactaggtatttttctccctttgattaccactaattgtgcagttcttggcgttgcactgcttaatataaacttagctcataacttaactcaatccgtcatttatggattttccgcttcacttggcttttctcttgttcttgttctgtttgccgctttgcgtgaacgccttactgcggcagatattccccttccctttcggggagcctctattgcgttaattaccgctggactaatgtctcttgcctttatgggcttttccggtttagtgagagtttaagcaatggcaacattacattatgttctgctgattatcgttttacttgccgctctttttggggcaattttaggttttgcctcaattaaattaaaagttgaaggcgatcctatcgtagaaaaaattgatgcgttgttaccacaaagtcaatgtgcacaatgcggttatcccggttgcaaaccttatgctcaagctattgcgaatggagatgaaatcactaagtgtgtacctggtgggcaaccattagtcatcaaaatagcagatttattaggcatagaagcacctagcggtaattttgaaaaagatcccctacccaaagtggcattcattgacgaagatatgtgtattggttgtacaaaatgtattcaagcctgccctgttgatgccatcattggtacaaataaagcgatgcacaccattattgccgatctttgtaccggttgtgaactttgtgttgcaccttgcccaacagattgtatttcaatgatcaacgtcaaacaacatattgataactgggattggaagttcgatcctaagttagttattcccatcgttgatactacttcagcacaaaagaaaatcgttgtaggagaatagggaatgacacagcgtatagatatattaaccaattacaattcaggtaaactttgggatttttatggaggtattcatccgccggagatgaaatctcaatccaatcaaaaccctataaaaaacttgcctttagccaatacattttatgttccggtcaagcaacatgccggaagtgcgggtaatattttggttaaggtaggagatagagtcttaaaaggtcaagccttaacgcttggctcaggtttaaacgcattgcctgttcatgcccccacatcaggtattatcaaaaatattgccccttatgttgccgctcatccttcaggtctatgcgaattaagtattgaaattgaatccgatggattggaacaatggcgaaaacgccactcaatagaggactttttaacacttagccgagaacaactcattgataaaatttatcaagcaggtatcgcaggattgggcggtgcggtttttccaaccgccgccaaaattcgatcagcaaacaataaagttaaactattaattattaatggtgcagaatgtgagccttatatcacttgtgatgatcgcttaatgcgtgattacagtgaagaaattattgaaggtatccgcattctccgttatatcttacgtcctgaaaaagcggtgattgcaattgaagataataaaccggaagctatcgcagcattgcgacaaagtttgcatggtgctaacgatattgatattcgtgtcattccaactaaatatccttccggtgcagcaaagcaacttatccaaattctaactggatttgaggtagcaagcggacaacgctcatccagtataggtattttaatgcacaatgtgggaacagcttttgccataaaacgtgccattattaatgatgaacctttaattgaacgagtagttaccttaaccggagataaaattgcacaaaaagggaatttttgggttcctttgggaacgccaatctcccatgtactaacacaagtcgcctatcaatatgattcacgtttccctgtttttatgggtggacctatgatgggattcatcttaccgaatttatatgcccctgtaactaaagcgactaactgcttactggcaccggatcattttgaatatgaaccgccggcaacggaacaatcttgtattcgttgctctgcttgctccgatgcctgccctgtacatttaatgcctcaacaactgtattggtttgccagagcggaggatcataaaaagtccgaagaatacgccctaaaagagtgtattgaatgtggtttatgtgcctatgtttgtccgagtcatattcctctcattcaatatttccgccaagaaaaagcaaaaatttgggaaattaaagaaaaggcacaaaaatcagaagaagccaaaattcgttttgaggctcgtcaagctcgcttagaaaaagaagaacaagaacgcagagcaagggttaataaagcagcggaaaatcgccgtgcagaaatggcacaacaaaaaggaattgatccagttcaagccgcacttgaacgcttaaaagcgaagaaatcaatcgaaacacgtgaacacaaccaagaacagaaaacgtttataaatattaaaggcgaaatattgcctgataacagcgacatcatagagcaacgtaaagcacgtcgtttggttcgtcagcaaaccaattcaaacagcattcaagaaattgaaactgttgtacaaaattcggagaaaaatacagaaaaaagtgcggtacaatctggcgtagatccgaaaaaagccgctgttgccgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaaaaaacaggcttcacaaattactgcaaatagtattttggagcctgatactacaatacaaaatacagaaaaaagtgcggtgcaatctgacatagatccgaaaaaagccgctgttgccgctgctattgctcgtgctaaagcaaagcaattagcaaaaaaacaaattgaagttaccaataaatgaaacaaagagattttacatgtttaaaatgattagctccccacatactcattcggggaaattgacagcccgcataatgttatgggtgattgtggcaatgttaccggcaatcgcagggcaagtatattacttcggatttggcgttttgatccaatcactgttggcaataagtacggcgttatccctcgagtttgttgtaaccttattgcgtaaaaaaccaaaatttttttatattggtgattttagcgttgttttgaccgcgcttattctcgcagttgccattccgccttatgccccctattggattattattatcggtacctgttgtgctgtaattttaggtaaacatgtttacggcggattaggacaaaatttatttaatccagcaatggttggctatgtcattttgcttatttcatttcccctacaaatgacaacttggttacctccaattcaactgcttaacgaaccacctcattttgccgatgcgtataaactcattttccaaggtgttaccactgatggttttaatttaagccaattaatattggctattgacggtatgagccaagcaacgccattagacacagttaaaacagcgatgcggaacaatttatcttcattacacgaagtcagctcatcacctattttcagttcggttctaccattgggcaaaagggatattgttgaaggaatgggctggacacaaataaatttactcttttttctagggggtatcttcctaatttggaaaaaaattattcattggcaaattccaaccgcacttttagcaacaatttttagttttgcattgttgaactggttattttccccagtcacaccaaatcccatttggcatttagtcagcggtgctacaatgttcggtgcattctttattgccacagatcctgttaccgcctccattacaccgagaggaaaactcattttcggtgctttagtcggattattaatctgcttaattcgtttttggggaaattatcctgatggcgttgcttttgctattttactggcgaatatttgcgtgccgctaattgatcattacactcgtccacgtgttataggccataacaaaaaaggaatcaaacaatgagcgttacacaaataagtagaaaatatggcatattattgggaacagtcgcctttatttgtaccgcactttccggtgcggtatattggctcacgaaggataaaattgcttttgcaatcgctaagcaagagaaaatgctgttagctgaagtaatgcctccaaattattatgacaatgatctgttagccgactgcaaaatgctctcatcttctttggcaaaagaatatcgtattaataaactttgtacagcaaaaaaaaatcagcaaattagtgcttacgcttatgaaactatcgcaccggacggctactccggcaatataaaaatgttggtcgcaattacacgacaaggcgaagtgctgggcgttcgaattacggaacatcaagaaacccccggtctaggcgataaaattgaattacgaatttccgattgggtcctgaattttgcccataaaatgttacagccaaacaatttaaacgattgggcagtcaaaaaagacggcggtcaattcgatcaatttaccggtgctaccattacgcctcgtgctgttgtaaatcaagttaaaacttctgggataatacttctaacacaacttgataaacttgctgtggagaatgaagaatgagtacaaaaaatctacccgaaacacaccgcactttagatgaatttgaaccctctcatttgactgtaaacaaggttaaaaccgaaagtgtatgggtaaatttatttaaacaaggattttggcataacaaccctgccctagttcagctattaggactctgccctttacttgcggtatcaaattcagcgacaaatgctttaggtttaggcattgcaactattatcgttttaatttgtagcaatactgtagtttctttgtttcgcaaacaaatccctcaagaaatccgtatccccatttatgtgatgattattgcgactacggtaacgatagtgcaacttatcatgaatgcttatacttacaccctttatcaagcattaggtatttttattccattgattgtgaccaactgcattgtgattgggcgtgcggaagcgtttgcctcaaaaaataccgttttacattccatttttgatgggtttgctatgggacttggcatgaccttcagtttgtttattttaggtgcattacgtgaaattttcggtacggggaaattattttttggtatagaaaatttatttggcgactgggcaaaatgtttacaactgaacctatttcaattagacaatagtttcttactggcaatcttaccgcccggagcgtttatcggtctaggcattatgttagcaataaaaaacgtgatagatcacagaaaatgaataaacaaaaacgtatcgaaatattaactcgtctgcgtgatcaaaatccgcaccccacgactgaattgcattttaatacaccttttgaattacttattgcagtcattctctctgcacaagcaacagataaaggagtaaataaagcaacagataaactttttcctttagctaataccccacaagccattttagatcttggtttggatgagttaaaaaaatatataaaaacgattgggttatacaatagtaaagctgaaaatattattaaaacttgccgtgatttaattgaaaagcacaatggtcaagttccggaaaatcgagaagcattggaagcactggcaggcgtaggcagaaaaacggctaatgttgttcttaatacagcttttggtcatcctactattgccgttgacacacatattttccgagtgtctaatcgtacgggatttgctcccggaaaagatgtcgtaaaagtagaagaaaaattattgaaagttgtaccatcagagtttaaagtggatgtacaccactggttaattttacatggtcgctatacttgcattgcaagaaaaccgagatgtggctcttgtattattgaagacttatgtgaatttaaagaaaaaacagagatttaacataaattataaatagaaacgaaggtataacattatgacaaacaccccaaaaagacaaacttggtccagtcgattaacctatgtcatgacagtagccggagcaaccgttggatttggtgcaacttggcgatttccttatttagtaggtgaaaatggcggcggtgcttatgtactgctcttttgtattgccatgttagttatcggcattccaatgattttagtggaaaatgtcatcggtcgtcgcttacgtgttaattcaattgatgcattcagtgataaattagaaggaaaaaatatttctaaagcgtggaaaattattggctatatgggattactcggtgcatttggtattatggcgtactatatggtacttggtggttgggtaatgaattatatcatcaatctcattaccggttccctagatatttcatcggtaattaacaaagaatatgcccaaaatttttatcaagagagtattactgaaagtccgctacaaatcataatttatacactgatttttgtcgtcattaactatattattcttgctaaaggaattattggcggcattgagcaagcggtaaaatatttgatgcccttattgtttatttgccttatcggtatggttattcgtaacgttactttaccgggagcaatggaaggaattatttattacctcaaacctgatttttctaaaatcacgccacaattgtttatcctcgtacttggacaagttttctttgcactaagtttgggatttggtgtaattatcacactttccagttacctcagcaaagaagaaaatctcatccaaaccgccgttataaccggatttacaaatacaattatagctgtcctgtcaggctttatgattttcccgtcattatttacttttgggattgaaccgaatgcaggaccaaccttagttttccaaagtttacccattgttttctcacacttatgggcagggcgtatttttgctgttgtcttctttagcttactgctcatcgcagccctaacaacctcaatcaccatttatgaagtaattattaccgcactacaagaaaaacttagaatgcgtcgtgcaaaagcaatttttatcacgttaggcacaattttcttaatcggtaatattccatcaatattaagtgataatttgttaaaagacgtcacattctttggtaaaagtatcttcgatacgtttgattacgtcagcggtaatattttatttttattgaccgcacttgggtgtgctatttttgtaggctttgtactaaaagaagatgcgataaaagaactctccccaaatccaaattctttatcgactcagatttggttcaattatgtaaaatttgctgtaccattaattattatcgtgatttttgtaagtaattttgtttaatctaaaactgtttaatttatagaggacactatgcaccatatatttatctcagataaaaataatgatatccgtcgtcatcatattgaaaatgaaactaaaaaattagggattacccctaatttttatgatgcaattatggcacgtgatttatcaaaagaagaattatcaacgcttactatccctaatacatttttaaccccaggagaaatttgttgtgcaaaaagtcatctggaggggggggggtaaaacgattgttagaaagcaatcaagaatacatttttatttttgaagatgatattctcttttctgataactttacgcctgaagtcattaacgaaattacaaactttatatcctctttgcaaaatccatctattctagttttatttaacagcatttataaaaagaaaaaagtaaaagatcttaatagtgctatatctattttttctgctcacaatttattctatgcttgtggctatgtcattaacagacaagcagcagaaaatattctaaacatccaaacgccaatcaagtttgaaattgatgcttttaagttttattactggttagatgcctgcgatttatattgtctaaatactgacttagtaaaacccgctccagaaatttcaaacttatcagagatagattgcgacaaccctagaaaatatacaaagcaacgcacaattaagaaaaataacgcatatcgtcttttatacaatcaactgagttggcaaaataaattaaaagcaaatataaagagaatacaaaaaatgttacataaaccctttgaaaaattgtagtttgtaatacattctgaatgggtagctttgtaggcagaaatcaataatctaactttttaggttagattatttctgttatttactcctttaagatacctaaattccaattttctgctgacgttggacgtttttcttgcaataagaaacgttgatttgcctttgcttgaggttgtattactttacttgatggtgtagagaaagaaataccgcctttaagcaattgctgcatggttcccgtattaatggacaatccgctcaagccaatttccacaccgtacccggaagaaatccaaaactctgtattttggcgaacaaagtgttggtatttcttagcaattaataaatgaactaaaactcgatcacctaattgatttagttccagtttagatatagtacctacctctataccacgatacatcacaggagatccgatactgatgtttgtggcatcagtggcttccagaataattggaaagccgttgccgtatttgtttgccggaggtacggacgaaagcaaattaaagtttgttttttttgcaccttgtccaatttctacatcaatataaggttgtaataaactatcaatattatcaatgccaccggctgaaatgtgcggtgaaataaggcgaaatttactgttttctttcgcaatgatattcatgtattttgcatgaattaatgcagtagcctcgattttatgatcttcggttagattaatttgctctatttctcctataggaagccccatatagcgtagtgccatacctttagtcaagtttgttgcatcatcagcaataaacgtaataacttgttctgccgatttggctttcatttcatttgcataaagggttttattgcttcctgagcctgaattatcaaaactgaccgcacctttcaaagaacgggcgataggggttgcctgaatactaatgccctttggcgttatatcaatttgtgtcgcactttctacccaaaaaagacttttggttgtaagtaaatgtttatgtttggggtaaataaaaacatcaacttcaaaatgattagccgttggtctaatatctaaaatcttaccaacttcatattgacgataaagtacaagcgagcctttatttatacttggtagattttttgtagttaacgtgatattaggctctaaaatattatcggtaataccgaattctgcactggttaaatccttatacaaaggatattcttgttgtgcttgtccttcctttttaccgcttgatataaccctaattcccccttgcaaccattttttcggactagcagcttccattcttaagccatcaatacccaaactaatatcaaagttactcgctgcaataaataatgtatttttatgaataagttgacgatatttttctgctattgctacttggaaaataacgcgttccagtgtactggtaatgttgacaatttcgccaatattttggtgattatagtaaagtggttgcccttctgtaataccgtaggtttcgggtgaaatgaggtttattactagggtattgggttgtttgagtaaaagctcgttttctttaatgacatgaaaagtcgtttgtgcttctcccataccggcaataacatcaatgtattttcctcgcaaaaaatttttcacatcggttaaatcgccgagcgaaagtttttgatcacgtaaaacaagaattgagcctgttttaaacaaatatttcatattcggatcaactaataatttcccgtgtaaaattttttcgctattttctaccgcacttaattcagataacacgccaatttgtatatcttgcgaatagattttagtgtgtccagcatctaatcctgctacattaggaacaataacgttgatttccgtacctcttttagcagcttgaatattttcatataacgtatagtgtgcattattttcagctctaggactttctcttggagaatcaaatgcaacagccccctgtactattgcgtttaagctatctgcttgaatattgatacctgataaacttaaatttgcgttgattccggtaatgttccaaaaatgactgtcttttttgacaaagtgagaataggctttgttgatgataacatcaacttcaacttttttctgatctttcgtgaaccggtaatcggcaatttgtcccacaggaatttttttaaagtaaaccgaggctccgctggataaagaacccaaatcatctgccagtaaatgaattaacaaatcaccatcattaacttgtgttaatggagcttcggtttccgcaataaacgtattttccggcttaccaccgccgggttgtaatgtgatataattaccagaaactaaagcatcaattccggagattcccgccaaagaagcactaggctgcactaaccaaaattttgtattttccttgaggatgctttttgcctccggataaatatttgctaatacttccacttttttgagatcatcagtgaaatttactttttttactacgccaatttgtaacccttgatagcgaatttgtgtttttccggcaactaaaccggctccattcacaaaagttatcttaatactttccccttgctctttaataatctgaaagaacaaaagtgtacagatacataatgcaataaagggcagtaaccaaaaaggcgatatacgtttggtttgtttaatttgggctttcaattcttccattgtttctatttgattatctaattttttgtttgtcataaatattccaaagtaaacgactatcaaattgtgaagtcgacatcattgttaaaaataccgttgctccgaaataaaatgcggcaggacctactgaaaaatcaataagttgccctcttgttactaatgacatcatcagagcaagtacaaataagtcaagcatggaccaacgtcctacgaaatgtacaaaatggagcaagcgtatttgcaggtgaatcgaatgttgccatttaaaatgaatggagaacaaaagataacacataattaaaatcttactgaaaggaataaaaatactggcaacaaatacaacaaatgctacaaagtagcttcctaaattgataaaggtcagaacgccggacattaatgtgtcttctgttgctataccgttcacataaactatcgacattggaagcaaattagcaggaataatcattacgaccgcagccaataaggttgcccaagttcgctgtaaatagacttcatctgaaaaatcaaggcgtgatagacaacgtgggcaaatggggcgtcgttttctatccgtatgacaatgattgaaagtatgttcacaatgcttgcacgcaataataggaagatttttttgttgtagcggagttttttggggataaaaatgccgccacaattcagcaggattgatttttataaataataatgtggtcaaaagtgcggtaaaaataaatgcaattaaatagctattaatatgtaggcttgcatattcttgtactttgaacatggttacgcccaaagcaactaaataaacatcaaacatcacccagggttttagataatttaacgttaacagtaagtgacgaggtctgatgtctaatagctgtgataaacgaagtaaaataactaataaagcaaagcttataggcataaataccgcacatagaaaaatcataaatgcagtgtaaggatagccttgaattgccattttccatataccttgccaaacagacgcatttactggcgtaccaagcaggttgatggttaataatgggtatcctaaggcaaacggcattaaaatcaaaatagtcaatgcgatgattgcacaacgtttcaaattccaactggaggtgttttgcagtactttgtgacaacgaggacaattcgctgattgatttttttgtaataagccaacagaaactaacgcattacaatcagtgcaacttataaggcagtatttagcttgtgataaattagtttttttctgcatgttgtcttattgatgaataataaagaaaggctattctaacctaatttttatcggaaatactatttttcattatagccataagagaaaagtgcggtcatttttagtgaaagtttcgtttcatttaagtattaattgtttatttttttttgttttaagctaaaatgtggcgagtttttttatctaaaaagtcattaagacaggaatatataacatgactgaaattcaaaaattaacaaataacaaagaaattattgcttacttagcagaaaagttcccattatgtttttcattggaaggtgaagcgaaaccattgaaaattggtttatttcaggatttggctgaagcgttagcaaacgatgaaaaagtgagtaaaactcaattacgccaagccttgcgtcaatatacttctaactggcgttatttacatggttgtcgtgccggtgcggtacgtgtggatttaaatggtgaacctgccggtattttagaacaagagcacgttgagcatgccgcagctaagttagcagaagctaaagcgaaagttgctgaaagacgtgcggttgaaaaagcaaataatccaaaagcaaataaaaaacgctctgtacatcgttcagcgaataagtcagaaaataagaaatcagctggaaagaaattctccaaaccccgtcaagttgaacaaatttttgtcaacgttgatttagcaaatttacaaaaaggagatgtggtgagagttaaagcgggagataaaactactaaggctgagatattagaagtggttaaagagggtgcccgtgttgaattagagaatggattgatattaactgtaagtgcggatcgtttatttgcgtaattttataatacatggctaatttagtacctcgtctcctctggtattattttcgtgtttaattattttaggaaagtgatctatgaaattacctcaacaactgcgttatttgctttgtttgctgtttggctttgttttaagtttaaattatgccgtcgcagttgaaccaaaactgaaactaacggatcttgttattccacagataacgcaagaaaatcaattagcaactaaaagaactgctgctcgtttggttcattcacattatcaagcagtagaactcaatgatgagttttctcagcggatttttgatcgttatttgaaagcacttgattttaatcgtaatacttttttgcaatctgatattgataatatgagagcaacgtatgcggataaaattgatgatgtgttaaatgagggaaaactagatattgcctttaatatgtatgagttattgatgaagcgtcgctatgagcgttatcgttatgctctatctttattggatgaagagcctgatttaaatggcaatgatcaaattgaaatagatcgggaaaaagcggattggccaaaaaatgaaactgaggcaaataagttatgggaacatcgagtcaaaaatgatgtgattaacttaaagttaaaaggtaaaaaatggcctgaaattcaaacgaggttagttaaacgttataatttagctattcagcatctaagtaaagtaaagtctgatgatattgtacaattgtatttgaatgcttttgcaagagagattgatccccataccagttatctggcacctcgcacagctaaaaatttcaatgaaaacatgaacttgtctcttgagggaataggtgcaactttacagtcagaagatggtgaaaccactataaaatcgcttgttcccggtgctccggcagatcgtagtaaaaagcttaaagccggtgataaaattattggagtcgggcaagcgacaggggaaattgaagatgtagtcggttggcgtattgatgatgttgttgataaaatcaaggggaagaaaggaacaaaagttcgtttagaaatagaaccagctaaaggtggaaaatctcaaattattacgttagtgcgagatcgtgttcgtttagaagatcaggctgctaaactaacagttgaaactgttgctggtaacaagatcgccgtgattaaaattccggggttttataatggcttaactgaggatgtacgtaaattacttgttgaagttgaagctaaaaaagcggaagctttaatcattgatttacgtggaaatggtggtggctctttaccggaagctattgagttaaccggtttatttattactgacggtcctgtggttcaagttcgggacgcacatcaacgtattcgtatatatgatgatcctgatacagagcaagtttattccggtcccttgcttgttatgattgaccgatttagtgcatccgcatcggagattttttcagctgcgatgcaagattataatcgagctattattcttgggcaaaatacttttggcaaaggaacggttcagcaaagtagatcactgaactttgtatatgattcaaatagtatggctcctttgggtttactgcaatatactattcaaaagttttatagaattaacggtggcagtactcaattaaaaggagtcgctccggatattatttttccctcctctattgatgatgaagaatatggggaagaaaaagaagataatgcgttaccttgggataaaattccatcagcgtcatattctgaagtcggtaatgcacgcctgccggtagatatattgaatcagaaacatcttgaacgtattgcgaaagaccctgagtttattgcactggatgaagatttaaagattcgtgatgaaagaaaagaacgtaagtttttatcgttgaactttactcaaagaaaagctgaaaatgataaagatgatgaaaaacgcttgaaagatcttaatgctcgtttcaaacgagaagggaaaaaaccactaaaagatcttgatgctttgccgaaagattatgaggatcctgatttttatttaaaagaagctctgaagattgcggtagatttaattgaatttaataaaaaaatggctgagtaaaataagatttaaaatatccgcacttttgaaaagtgcggtcttttttgttatctaaggaactaacatgcgaaaaattaaagttatcttattaatcttattattaggcactacgactcatatttatgcacaacaaaagtttacttctgtagatgagattaataacattactttaagtaaatcacaattattgtttgaattagatttattggaacaacaactatccaaggaatatcagcctagattatatgaacaattacattctttgctcagaaatatagatttacaatttaaaactacaattggtcgtatttatgttgaaaatgactatgcattgctttgggaagataagcaagccgaaaaaatgtttttacgtgaatatgccgcaatagttgcaagcggagtatctgaaagagcggcaagattattgaatgatatttataaagcatctgaaataggagggttagtttatgatatgttgctgaccgatgcatttttggattatatgtattattcaaaaaatgcaaaaaattttgcacaacagtggttttactcagcaaatagctacaaagctcaattaccatcaaaacaagatattcaacgatggctatcatcaataaaacataatgaaaatttgatgttcatcgaacaattagctcaacataatgagcaatatgagaaaattataactcacctgagtaaattaatacctcaagatgacaagtcaatattatacaaattagcaattaatgctcagcgtttaaggattattcctgattttaacaatggtatttttgttaatattccaagttatcaattaaattattatagagatggagaattagttttaaactctaaagtcattgtcggtaaaaaagcacgtaaaacaccggtaatgtatagtaagctaagtaatattgttgttaatccaccttggatacctactcctcgtttaattaatgaagatatcgtgccaaagattaaacttgatccggattatgttgctcgtaatagttataccataagtgatagcaaggggcaggttatagatccttcttcaatagattggaatactataggcactaattttccctatcgaatccgccaagctccgggaggaagtgcattaggaaactataaatttaatatgcccagttcagatgcaatttatttacacgatacacccaatagaggattatttagcaaaaaaaatagagcattaagttcaggttgtgttcgtgtagaaaagtcagatcaactggcgacaattttattaacagaagccggttggacagaagaacgtaagcaaaacgtgcttaatagtaaaaaaaatacttcggagaatattcgctccgataatcctgtatatttatattatgttactacttgggttgaaaacgatgtcgtgaaaacattacctgatatttatgagtatgatcaagtacctcatttaacttatattaactggaatattattaaatggtatctaaattaaaatgtgagcagcaagaactaaatgttatgtttgctgtcgaaagcaaatcatttagcactttataacgaaatattatatgaatgaaattaatcaaaatcgtcgcaaatggctatctttaggagggattattcttggtgcagccttgttacctcaaagtgttttagccgtattaccgaagccttctaaatctaaatttttatcttttagaaacatcaataccggagagagatttcgtggtgagttttttgccaataaaggtttttccagctctgatttgaaaaaaatagatcatttaatgcgagataaacgcaataatcaaattcataaaatggatcccaagttatttcataaatttgttcatattcaaaacaacttaggtttgcaaaattctgaaattcaaattatttgcgggtatcgttctccggcgagtaattccgccatgctacgtagtggtcgaggtgtcgcacgtaacagctatcatactcgtggacaagcaattgattttcgcattgagggggtttcattagcgaaacttcgtcaaacagcagaaaatttgaaaaatggcggtgttggttactatcctcgcagcaattttattcatgtggatacggggccagttcgtacttggcgaggtagctaaaatactaaacgtaatatagttgaccgcactttattcaaagtgcggttttattatttaaataaataaggaaatgatatgaatattgaaattgtgccggtaacggcatttcagcaaaattgttcaatcatttgggataataacaaaagtgcggctattattgatcccggtggtgaagcgacaaaattaattaaacgcattgaagaattaggcttaaatcttgaattgatcttactgacccatggacatattgatcatgtcggagccgcactgaagttaaaacaatattttaatgtagaaatttggggttctaatgaaaaagatgattttttatttaatagcttaccacaacaatctgagcaatttggcttactttttgagactgaggtatttaaacctgatagatggttaaatcaggagtatgaaattgtccgtattggggaaatgaattttgaagtattgcatcttccggggcatactcccggtcatgtcggttttatcgaatatagtaaaaaaattgcttttaccggagatgttttgttccaaaatagtatcggaagaacagactttccaagaggaaatcatgctgaattaattcaatctattcgtgacaagttatggaagttagatgatgatatgattattattgcaggacatggtaattatacaaccataggaaaagagaaaaaatacaatccttatatccgctaaaagttaagatgcaaattatgttattgatttacacttaaaggacaattcactagaatagtcaacatttattaatttatcttgaattctataaaggtagcaaaatgattgatccaactttattacgcaataatctttctgaaattgcggaaaaattaaaagtaagacgtggctttattctcgacgtaaataaattttcacaattagaagaacaacgtaagactttacaaattaaaacggaaactttacaagccgaacgtaactctcgctcaaaaacaattggtgcggcaaaagccagaggagaagatatttctactttattggcagaagttgatcatatgggagccgaattaaatactgtcaaagaagaattagcgaatgtattaacggaaattgagcaattggcattaacaattcccaatattcctgctgatgaagtacctttaggaaaagatgattctgataataaagaagtttttcgttggggaacaccaaaaaaatttgatttcgaagtgaaagatcatgttgccttaggggaaatattaggtgggctagattttgctgccggtgttaaattaagtggtgctcgttttgccgtaataaaagggcaaattgcaagaatgcatcgagccttggcacagtttatgctagatttacatactgagcaacatggctatacagaggcttatgtaccttatttagtcaatcatacaacactttatggaacggggcagttaccaaaatttggtgaggagttatttcatataaaacccctagaaaatgaacagacttatgcgttaatccctaccgccgaagtgcctgtaacaaacttagttcgagatgaaatcatcgatgaggctgatttaccaataaaaatgaccgcacatacgccttgtttccgttctgaagcaggttcttacggtcgtgatactcgaggtttaatccgtatgcatcaatttgataaggttgaattagtacaaattgttgaaccggaaaaatcaatggaagcactggaagaattgacaaatcaggcagaaaaagtattacaacttttaaatttaccttatcgtaaagttttattgtgtacaggcgacatgggattcggagctactaaaacatatgatttggaagtatggattccggcacaaaatacgtatcgtgagatttcttcttgctcaaatatgtgggatttccaagcacgtcgtatgcaagcccgttgtcgtgcaaaaggcgataaaaaaacacgcttagtacatactttaaatggatcgggactagctgttggtcgcactttagttgccattcttgaaaattatcaaaatgcagatggctctattaccgtaccggaagtattacgcccttatatgaatggaatagaaattattggtaaataatctgttgccgaaagataacaacgctccttttgggagcgttatctcatcaagccaaacctgtcataatcttactctcaaagaaatcataatctactaaaaaagcatcatgtccataatctgaaggaaattcataataatttaaatcaacgccgctttgctccaataatgctttacttttatgtagatcggtcaatttaaacaactgatcagtggtaactgcgaccaaagtatagcgtgcttttatacgacttaatgcagccttaatgtccttatagttccaagccggatcatataaatctaaagcccgcaataaatgcacatagctattggcatcaaaacgttccaaaaattttttcccttgataagttaaataagattcaacttggaaataatctccccaatacagactttccgcttttttagctcgtccaaacgctttttctaattgaaaatcggtacgataggtcagcatacccaacattctcgcaatagataaccctttacttggaggcagtctgtcataataatctccattattaaaatgaggatcattaataatcgcttgacgcatcacatgattaaacccgattgcctccgcacttaaataaagtgacgaacaaagattaaccactctgctaacgcaatcaggataatcaatagcccattgtgtcgcttgcattcccccgaacgagccaccaatcacagcataaagttttgctatatccaatgtattcagcagttctcgctgaactttcaccatatcttgtacaataatatgcggaaactgactaccgtaaggtttatttgtatcaggattaatggacgaaggacctgttgtccctttacagccacccaatacattagaacaaataaaaaaatatttactcgtatcaagtgccaatccctcccccataaaactctgccaccaaccattttgcgatttatcagcaaaatagggttcagcatcgccggtcaaagcatgacaaattaaaatgacattgctcttatctttatttaaagcaccataagtctgataagcaacttcaatattttttaattgcccaccttgtactaacatcaagggataatcggtaaaaagcgttaaagtttgtacagccatgtaaatttctcaaaaatcttaataaaaagcaccgcactttataaaagtaacccctgtaaactactcatactctgtttcattgtcaaggaatttttagccatctaaacatctggacagccaataaaatttacttgaaattacccgcttttttcattattttgtagcctccgaacgaggcagctataaaatgaacttagatttcacacaactttcttttccacaatggataataacgctcgtcaagcgattactacattacagctttgctttcagcatttttacatttttttcccttattatcattgatcgtagcatagcttggtatgttcaggacagaatttatacaaaaattgaagaacttccctaccgcccttatggtattgtgctaggcacagcgaaatactttagtaaaaataatcccaatctttattacaacaatcgcctgactgctactgttgagctttttaaacaagagaaaattgattatttattattgagtggtgataacagaacaatgcaatacaatgaacccataaccatgtttaaagatttgcgaaaaatggatattccggaagatgttatgtatatggattttgccggttttagaacgttagattccgtcattcgtgcagataaagtctttaaagcacagcccatgacaattattacccaacaatttcactgcgaacgggccttatttatcgcaaaattctacgatattgatgctatctgctttgcggcaaaatcacctactaactacttatctgtacgaatgagagaattatttgcaagagtaaaagcgattttagatattgtattagaaaaagagccttattttttgggaaatccagaaccgctcccaacgccaataactcaattatgatcttcgctaaataatctagcaagcttataaaaaagacaataaagttaaaaatcccatcaggcaacatattattttccaaccattttctaccgcacttttagcaaaacatttattaatcacgaacaagtaaaaattttaaggttttacacagacttatatttgtcaagattgaaaaaagaaaaaaaacagaaaaattttaaaaaaaacttctagacttaatgtaaccatttgaaaaataatgaaatgttattttacaaccaattttatatgaggatatggaaaccctagattttacaaggtttaagcgaaataaatcttgaataatttacagagttatccacaggttatgtggatagtaatttgcatgaaaaaatttttactataataaaaaaatcctgttgacaagcatacaccagatcattatcatacgcacctctccttatgagaccatatttatggtatttttcctccttagttcagtcggtagaacggcggactgttaatccgtatgtcgctggttcaagtccagcaggaggagccagttttttcttttgggttgtttttatttgtctccttttataaaaactcaatttaccaaaagactttaagcccatttagatcttctccttgtatgggcttttattttttcttttctatattcaaatttctcgaaatttattttatactcgctactttcacacttcatttatatctcgtttaggttcaaatatgttattccctatactcgctattatttcaggtttaattattttagtttggagtgctgatcgttttattgacggtgctgcatcgctggctcgtttcctcggtatgtccgcattattgatcggcattatcattgttggttttggaacatctgcccctgaaatgatcgtttctgccctttccgctttaaatggaaatcccgggcttgctttaggtaatgcttatggttcaaatattggtaatattgccctaattttaggtttaaccgccttaatcaaacctgttatagttaattcgctggttttaaaacaagaattacccattttaactttcgtcactttagtttctgcttacttaatttatgatgctgaaatttctcatttagatgcgattattttacttgttatttttgctatatacatggcttggagtatttggcaaagcaaaagatcagcacaagacagttttgccgaagatgtaacaacagaattggaagaaaaaaaaaccatatcagtaaaattagcagtattctggatgattacgggattgattttactaatgggaagctcacaattattggtgtggggagctgttcaaattgcttctcaattaggtgtgagtgatttagtgatcggtcttactattgtagcaattggcacttcattacctgagttagcagcctcaatcatggcggctcgtaaaggtgaagtagatcttgcggttggtaatattattggttctaatttatttaataccttagctgtcgttggcatagctggcttaatttccccaattcaagtgagcaatgaaatatttactcgagatatgttagttatggggggattaacgctctcactgttctttttcggctatggatctcgtcaaaaaaatggctcgattaatcgtattgaaggcggtttattgataacaagttatatcgtctatacttatttcctcattaccaccgcactttaaacaataaattaattgggagattaatttctcccaattaacaaagcacccccacgtatcggtaaagttgtgccatacattaaactcaaggcaaaaaatataatcatcagaccagcaagtatcctgactaggatatgccaaaacttcttatgtgttgaaaaataaaaatgccctaactgaaccgcacttttccgtgcatacaacacaattaatgcaaaacctgacagcattaatccaacacctaatgacatcgctacagtagccaacattccccaaacatacaaatccaacatatacgacaaaaataggataaatattgctccagaacaaggacgcattccaatagtgaaaataactaaacattgtgattttaaactctgtgcttgctgtaactgttgctgattgggtaaatgctgatgcccacaagaacaattatccgtatgctcatgaaatcttggcaaattttgtaccgcactttgcatacctattttattggtaggtattgaagagagtgtgaattgcttgatttttagcgactgactattttttttcaataaagacttgctcccttgccaaatccattgcaatcccaaaataatcatcaagagataagctccacgttctaaccaaagctgacttaatttaaaatagcttgaggataactgtaaaatagccacaacaattaatgtcagggaaatcgccacaataccttgcattaaagaagcacaaaaagttaatttcatactggtttttatctgggattgatgggttgctaaataactaccaataataaactttccatgccccggacctaacgcatggagaacaccataaataaaactcaccacaattaatcccattcctgcatagacaggggcttgttttacttgatgcaggtaacttgaaagtaattgattaaattctctctgccaaattaaaacgtgtgaaaataaatatgagaacagataaataccacctaacgataaaaatacaagcaataatataagtttataggttctttttattgacattggataactactttttgtgcaaatataacgcctaacgagctgtcttcatcacgttggttacgatctaaagaggcagcatattctcgtaatttttgatcaacttgaggttcgacaacatttccttgacaatgttgcggaagtgacgaaaaatctaccgcacttttctccttgtctttatcgtaatacatagatacatagtaggttgaatcataagtagataattcaaaacggttattggataactcctgaggtttagctaataaaaaatcaaaaaaatataaaacttgtgcaccgttagattttaatccatagttttgaggaattgcagaatacttaattttatttcctttcttatcatacaaataactaaaataatgttcattaacaacattttggatcatatcatcaataaatttttgtaattctttttgatcatcttgcaaaaaagccaaatcatataaaacagcagatgaacttgattcatctaaaatccattgcatagaaaaaccaactaatttttgcttgtcaataatgggttttgtctgcatttcaataaaagcgtgtgggtgagctaaactgtatataggcaaaaagccaagaataatcccgaataaacgaatgaattgttgcatattcttccaatcaaataactaagtacgcattatgctatcacaatatagcgttgatttttatcttttcaaaaaaatcatgagaagttgagtttgcggaaattaagccccctaaagaacagagttttacggcaccgtcagataaaaaacttacggattatcacacataaagctaacaaaaatcaataaaagtgcggtacaattcgcaagtttttcacttttaaaacgtggcttatgaactatcaaacatacattcctgatgaatatactatgtgtcaatttggtaaaaagttgatacatagtattgctcaaatcaaaagtaacaaaggaataaccctttatttacaaggtgatttaggagcaggaaaaactacgttaagtcggggaatgatccaaggtatagggcataccggtaatgttaaaagccctacttataccttagttgaagaatatcatcttgatgaaaaagatatttatcatttcgatctttaccgccttagtgatcctgaagaattggaatttatgggcattcgagattactttaatgaaagatccatttgcttaatcgaatgggcagaaaaagggcaaggcatattacctgagcctgatttaatcgttcatatcaattactttgatgatgcacgtagtattgaattacactctatatcagaacaaggccatttaattattcaacaattagtttaaaccatgaattacttacaacgcttgattttcattattttagcgattttcgcctttaatcatgcttttgctcacgtttggacaattgccatcgatcccggacatgggggaaaagaccccggtgctattggacgtcgtctcaatatctatgaaaaaaatgttaccctttccattgctcgtgaactaaagaaattgttagataaagatcctcactttcgtgccgtactcacacgagaaggcgattattatatttcagtctctaaacgctcggaaatcgcacgtaaacataaggcaaattatctcatctccattcatgccgattcatctgaatcaagtttgttacgtggtgcatcggtttgggttttatccaatcgccgagccaatagcgaaatgggacaatggctggaagatcatgaaaaacgttccgaattgttaggcggtgcaggtgatgtcttagcttcacataaagaaaaatatctagataaaactgtattggatctgcaatttggacatagccagcgtgttagttatgaacttggttcagttgttttacgtcactttgctcgtatcgcaaaattaagtcgtagcacaccgcaacatgccagtttaggcgttttacgttcccctgatattccgtctattttggttgaaacaggttttctttccaatgcggaagaagaaaaaaaattaaatacccttgcctaccgtaaaaaattggcaaaagttatttatgatagtttagtagaatatcgcaaacgcaatttaaaagtagatctcaataccacaaaaaatacccgccaaactaaaccaaaaaccaacagtgcggtagataatacaaacaaaacacccgttaaagacagcggtattcgtcataaagtaaaagcaggcgaaggattaacgagattagcaagaatctataaagtgaatattaaagatattatcagtttaaataaactcaatcgtaatcaactttggcttggtgaaataataaaaattcctgctaacaatgaaaatacaccaaaagagaaagagaaagcgaaagagaaaaagaaagctaaagataaaaatgcaacattccatatagtgaaaaaaaatcaaacactctatgcaatttcacgtcaatacaacattcctgtgaaaactttgctcaaactcaatcccaaactaaaagatggcaaagtacaaatagggcaaaaaattaaattacgtgaataagggctaagcaaacgtatgacaattaaaattcttcctccacaactggctaaccaaatagcggcgggcgaagtggtagagcgtccggcttctgtcgtcaaagaactgattgaaaacagcttggatgcaggagcgacacacattcaaattgagattgaaaatggcggtgcaaatttaattcgtattcgtgacaacggcataggaattgcaaaagatgaactccatttagcccttgctcgccacgcaacaagcaaaatcgccagccttgatgatcttgaaatgattttaagtttaggctttcgtggcgaagcacttgcaagtatcagttcagtttcccgtttaaccttaacctctcgtacagcacaacaaaatgaagcatggcaagtttatgcacaaggtcgagatatggaaaccagcatcacacccgcttctcatccgattggcacaacagttgaagtagcaaatttgttttttaatacgcctgccagacgcaaatttttacgtacagacaaaactgaatttgcacatattgatgaagtaatccgccgtatagcgttggcaaaacctcaagttgcttttacgttgacccataacaataaattaatacaccgctataaaagtgcggtaacaaatgagcaaaaaattaagcgtattgcgactatttgtggcaatgattttatgcaaaatgcgttacatattgattggaaacataatgatctgcatctttccggttgggttatacaacctcagtttgctcgtcatcaaaatgacctcaattattgttatatcaatggcagaatggtgcgagataaagtcattacgcatgctatccgtcaagcctattcagaataccttaacaacgaacaatatccggcatttgtattatttattgatctcaatccgaatgaagtagatgtaaacgtacacccaaccaaacatgaagttcgctttcatcaagctcgtctaattcacgattttatttatcaaggaattatgaatgcgttaacctctgagcaaaccaatagtccaacacatagtgaacaatctaacccaatcaaaattgccgaacctcaaggtatttggaacttgaccacgcataacaaaggtaatcgagcgactgccggcaaaaatatttttgcccagcaacctaaagattatgataaaaaatcgtctcaatttaaaccgcactttgcagcaaattacagcgaagtaacgccaaagaaagcagtgcaaaaagcctatgcagaattactcgcaacacatgaagaaaaaactatcgcctcttctactctaccccatcaatttacacacaatgcaacgcatatcagtgaacagaaaaatgttttacatgcacttgcattaattgaaaataaggcattgttattgcaacaaaaccaacaatatttcctcctttctattcaggcattgcagcatttcaatatccgcttacagttgcaacaaagtaatattgcacaacaaacattgcttattccgattttattgcgtttaaataaacaacaatatcaatcttggcaacagcaagctctattttttcaacaaagcggtttcgattttacagaaaattctgcgcaacacagaataactctaaaccgtttacctatttgcttgcgtacacaaaatatacaaaaaataattttacagttattggatcaacctcatgaaaaatacactatttttcttaccgcactttgctcacaattggaatttccctcgctcagtactttctccgaagctgtaaatttactcacaaaaactgagcaacaattttcaccccaacatcaaccagaattccaatctttattagtcaaaatagagtgggatcactatttagataaattgcaatgaataaaaaatcaactgctatctttttaatggggccaaccgcttccggcaaaaccgacctcgctatccaattacatcaagaacttcctgttgaagtcatcagtgtcgattcagctttaatttataaaggcatggacattggtacagcaaaacccaatgcacaagaattagcactaacacctcatcgtctaattgatattaaagatccaagtgaaaattattctgctgcagaatttcgtcatgacgcattacaagaaatgaaaaaaatcacgcaacaaggaaaaattccacttcttgttggcggtacaatgttgtattacaaagccttattggaaggactttcgccgcttccttcagcggatgaaaaagtgcggttggaaatagaacaaaaagcagaaaaatttggttgggcaacactacacaacgaattagccaaaatcgacccaatctcggcacaacgtataaatcccaacgacagccagcgaattaatcgtgcattggaggtcttctatttaacaggacaatctttaacggaattaaccgcacaaaaaggcgaagaaattccttatcacatcatacaatttgctatcgcaccagaacgagctgttttacaccaacgcattgaacaacgttttcataaaatgatcgaacaaggctttcaacaggaagtcgaaaaactttatcaacgctcggatctacaccctaacctaccctctattcgttgtgtcggttatcgacaaatgtgggaatatttacagggtaattatggtaaagacgaaatgatatttaggggtatttgtgccacaagacaattagcaaaacgacaacttacttggttgcgtggttggaaatcgcccatagaatggctagacagcctaaaccccaaaagcacgaaagaaaaaatcataaaaactataaaacataactgtaaataaagttcacaaaatcgtttttttctataaaaatttaggataaaatggctcgaatttttacttgacaaataaaatagaacggaaaaaatgacagcctacagcctacagcctacagcctacagcctacagcctacagcctacagcctacagcctacagcctacagcctacagcctacagcctacagcctacagcctacagcctacagcctacagcctacagcctannnnnnnnnnnnnnnnnnnnnnnnnnnnnnnnnnnnnnnnnnnnnnnnnnnnnnnnnnnnnnacagcctacagcctacagcctacagcctacagcctacagcctacagcctacagcctacagcctacagcctacagcctacagcctacagcctacagcctacagcctacagcctacagcctacagcctacagcctagtatattggctaaaatcaacctttcaagttaattttgagaggttggacatgttcaaacaatatcttaaaaatcacctatttcaacctcaacctttcggcgaaagtattattcgcctttttttgttgtgtcttaaaaagcaaggcatcgccgatttatttatcaatctatctaaaaagcaaarcgtttaatcaataaacaaccgtaaaaaagttaaaaaaatcaacaaaataaatcaataaaaaaacctaattttaaaagcttaaagagagtgaatttatgaacaaaatcttcaaaaccaaatacgatgtaacaactggacaaaccaaagtggtgtctgaattagcgaataaccgccaagtggcgagccgtgttgaggcgacggggcgtcagccgaagtgcggtgtgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattcagcaacattagacgaccatgcctcaaaatctatcgtgataggtaatggtgcaaaagttgaaaatacaaataaaactaaaaaaattgacgaaatgcattggcctgaggatgaaaaatataggaagggtgaaaaagaattagaaatgtcggctattgcgataggaactagtgcaatagctaacgctcaaaatagtgtagcactcggaaatgaagctcaagtaagcatggaaaattcggtggcattagggaataaatcacatacaaaatatttctatcaagatgataataacaaaaacactgccacgctcagcggaaacggcaaaaatgatgcgattaatttagccccttatattccagagggttctagctataacttaaaaaccgatacagcggcgggtattgtgtcsgtmggttggacaaaggataamagcaaaacacaagaactgggcttaagacggattgtcggggtggcaccgggtgcgttggactctgacgtggcgacgattggacaattaaaagccttagaatatgtaaaaagagaaggcttagtcgtttattatacggaagataatggaaaaatatataaattagttaaaggaacagatggaaaattctacaaggtcaataccaaaaatggcacaccattagataaacaagaaattccaaaagaaaaagtattagttggggctaaagggcataacgagaagatacaatacatagatgctgataaacaaattgcggacataggagaaaagataagattcgggcatttagccgatggmgagatttccaacaaatccgatcaggcgattactggggcacaacttkatgatcttaaaggtaagttggggttggaattagagaccaataatacacaattcaaaggacataattttacagcagttgaatatattgatggaamasaaggwwmrcaaaatacttttaaaggtgcaataacggaactgattaaagcygtcaataaaggttataagttcagtgatggaacgaaaactattgataagatttatttkggctcaacgattgaaataaaaccaraagatatttctaataatggtactcaatataagagtaaaaatttaaaaacaraagttgaaaaaaacagttcaaaggcaywattcaccatcggcttaaaagacgatccagaatttaatactgtaaaacttaccggcacccctacagataacaagcacgctgtcaataaggcatacgtggatgaaaaactcaaagacgtggcttcaaatatccactttatgtcagtacatacaccgaccacaacaccaaaaacaaaaggcaactatagcaacgacggwgcaaaagytgasggkgcgatygckatyggygtggacgcaagtgccgcttctgaaaactccatcgctatgggtaaarrytcraarattgakgmgrmaatatcgaacgccgtcgctatcggggcgaataatmacctyagagggaagaataaaggtcaagatacgaatackgtkgctattggttcaracaatatcatcacsggacgaaaagtygtgaatttaggttcggggaatargataggtaatactraagacrgttatcaamskgacccaaaagcagrtgcggtcagyrtacgaktratyggggacgataatawsgttsatggggtatggaataccgtcatcggtgaarrraatacatttacagattcctcagtctatgttcatttgatgggtgataaaaataccgtcacagattccaaaaataccatcatattaggcgataaaaatactgtctcaaaattagaaaactctatcatcattggtaaaaacataactgctaaatctaatgttaaaaacaataataatttaatcgtcatgggtaaccaagcccaagcaacaaatgcgaataacagtgtggtgatcggagcgtctgcaaaatctacagcggtaagtgcggtcgtgattggacaaaatgccgaatccaaagcccaaagtgcggtagttttaggtaaaggggcgactgttcaagccaacgccaccagtgcagtagcgattggtgaaggggcgtctgtatctacaaatgctggcgaatcaatagctttagggaaaggatcgcaagcgacggctaaagcgaatgcaatggcaaatgctactgtagagggcgtgaaatttgcctttgcaggtgggactggaaatagtaagacagtattaagcataggtaaagctggaacagagcgtgtcattaaacacgtggcagcgggcgaagtgagcaaaacctcaacagatgctattaacggaagtcaattgttcagtgtgacaacgggatttgcaaaattggcaaaagatgtcctcggggcggagttaagcacaactaatcaatttaaaaagtcagagtttaaagcattaaaagccacgagttcgtctgcggataccgcacaagcaaaaacatttagagaagcgattaatgcaaatatagaccaaattaataaaggcttggtatttagcgacggcacaacgcatggcacaagacagctgggcgaaacgatcaccatacaagccggcaatattgacggcggtgatttcgccagcgataacatcaaaacgaattacggtaaggatcaaggagtattcctaattggaattaaaaaagatccacgttttgaaaaagtcacagtaactaaagatgttgaagacggaagtcctgaaatgaccttaaccacgaaaaaatatgtggacagaaaacttgccaatgtcgccgctaaatttaccgtcaagggcgatactaacggaatagacggcaaagggtatgaattaaacaaagacaatacggaattgaatattaagggagatgataaaaacatcaccacagcagtggataaagacgctaaaaaattaaccgtatcgcttaagagtgctttaaccggcattacctcgattggaaaagataccaataatcaaatcgcctttaatggtgggacaacccttaaagccggcggtgcgagcttaacgttggcgaatgagggtggcaaagttaaattatcaaacgtagcaaatggtacggcggataatgacgcagtgaataaaagccaattggatcaaaaacaagataaattgacaggtactatcaccgcaaataatgggctaaaagtgacatcgggcgatgcgacaaatagcgttgcgaagagtatcacgttaagtttagaagatggcttaaaagacaaaatcgacaatgccttaagtaaaaccgaagcagggaatacctatgcgaaagtggatgcgtcgaatataaacaatggcaatcaaacagcatggagaaataaactaaatgtatattctaaagaagaaacaaatagtgaaatcgccaaagcgaaagaaacggtaacaaatggagatggaattactgttacagcaacagctacaggagatggacctaaaacatttaaggttgcattagaagatagttacaaaacaaaaattgataatataggtaccggaactgtcacagctaataatgataaaaccgtaacgggtggtgttgtatataatgctattgaagaggcaaaaacagctatagaaagcaaactttattcaaacacggcaacatttgggctaaaaggtaatgatagccaagaagtgaccaaaaaattaaataacagtatcgaaatcaaaggcactggcacggctagaactagcggcacaaatatctatgtctcgaaagccgatgaaaacggtctaaaaatcgaactgggtgaaaccttaaaaggtattacgtcgattactaagggcgataataagtctaaaatcgaatttaaagatgacagtatcgatttaacgccagttgatggtaaaactgtcactatcactaaagagggtaaaatcagcggcttgacagatggtcaaattgagaacgcctcaaaagacgtggtcacaggaaatcaattgcatgatctagcgggtaaattaggcgttagtgtggataaaaattctaaaaccggttttaccgcaccgttgtttgtcgccgtcaattatcaagggcaaacagcaactaacggaaaaactacctttaaagaagcaatcgatgatttgatcgtggctgtgaataaagggcttgtcattggcgacggtactgcaactggcacgcttcaactgggcgataccttgcagattaaagcggggaatatcgataaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaagaatatgtggatgcgaaattagccactaaagcagggacatttaaagtgagttcggataaaggtgacacaaacaatatcaccggcactttatctgtcaaaggtaaagaagatgatgctaatggcaaacatcaaaatattaaaacagaagcgacaggatcgaatttaacgatagcacttaatagcgacttaaaaggcatatcgactattggaaaagatgataaggctaagattagctttaataaagatactgctaaaaatgagatcgagtttagtttgggagataacacgaaatataaattcgatgagaatggattagacttaggaggtaaaaaaatcaccgcacttgcgagcggtttagggttgaaagatgctgatactggaaacggaaatgccgacattattaaaaaagtcctcgmgggaactcttgataatggcagtaacrttaaatccactaacgccgtcaatgtraaagacctktmcraagtsgcsraagcccttgtggaaaaaggactwtcmtttgaggggaatgatggaagtagtaataaagttactcgcaaactcggygagacgttgaaaattgtgggyaaaggaagtggtgctaactcaataacaaccactgaaaataatattaaagtgtctaaaaatacagcaaacgatggactggaaattggcttgtctgataytttaayaggtattaaatctgttgstaatggcgataatgcgaaaattactttaagcggaagtaatrgaagcaaggacaaaattaccttcaaagcaggtagttcagaggttaccctagccgatggtaaatttagcggtgtttctgaaattaataaagaagcggataaaggagcgttgaaactnnnnnnnnnnnnnnnnnnnnnnnnnnnnnnnnnnnnnnnnnnnnnnnnnnnnnnnnnnnnnnnnnnnnnnnnnnnnnnnnnnnaagaggataaagswgcgttaaaactcactgaaaacactgccactttagaaagtgcgaaagacggttcaaacctggcattggataataccagtgcmacsttaagtgcgggyaaagataarggmagtattaaagtyrccaatrrcrsrrmgaasaaaatcgagttaagtcckgaaaacggctcaaccgttacgttgaaaaaagacatgacaaatggcggagtgcaagccaccggcttgtctaccatcggtaaagatgagaataaygctttagtgtttaaaaatggtacgagtggcacraacacggcagagttaaaagtgggaggtgcgnykttaacattyacscctastggaaatggaattggyggaactaaccaaacagtgaaaatctctaatgttgcgactggtaatatagcgactgattcaaaagawgccatcaccggcrgacaacttgmygatttagcargtaaattrggggttgmkgttgatagtggaaaaactrcgtttacagcaccatcatttaatccgataaaaggtggtactaaaaatactgctagtggcacgactgcggctgccccaacaacctttaaagatgctattactcagttaatcaccgctgtgaatggcggcttgacctttacaggaaatgatacttcccaaagtaaaaccacattacaattaggtggaacattgaccattgatagttcgagtgctggtagtgaaaaagayattacagcaaaactggaaccgtctaatggtagtgatcctaaagataacggtaaattaacgctgacgttaaataaagctacttctgtagataaaaatgacgaaaaagtcattacctcwaaagcsgtagcaactgagctggaaaaatatacgaaaactgctgatttaggtratacgtatttgaaaatagacgggtcgaatattggtggtgcttcaggtaaacaaaaatttggtagcaatgtcggtattgctgaaatcaaacttggcgaaactgacaagagcgacactgaattggtacaagctaaagctttaatcagctatctaaaaggtacaggtcaaaaatccgttaaagtatccgataatccggaaactaaggctgaaggggactattctattgcgattggcgataaagcagtggcaaaaaatgaaagtgcaattgctatcggytatggtgctaaygcyaaaaatagaaackcacttgccwtaggyagagatagtgakgtattrggcgagcatgctacggctattggttwcmaaaataawgtatcgggcaatcattccggtgcattcgggaaacaaaacacggttarmggaragcattcctatgctgtgggtgcttataatacgataggcggcgaacacacttatgtcttgggttcaagtgtcacgacagatgacaaggtaaaaaatgctgttatcttaggtaatcaatcaacaggtgtatctgatgccgtgtctgtgggtagtgatacgaaacaaagacgaattgtttatgtcgccgatccaaaaaatcaatacgatgcggtgaataaacaatatgtcgatgcacttggattaaaattcaaaggtaatgatgataaaaatatacacagaaaattatcagaaacattagaaatagttggtaagggattaaataaaaaccaaactactaaatttaatggcacaaatggaaatattgctgttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctaatcactcgatatactaacgagagtggcaacgccaaaatcgaaatcgggtttaaagacgcaccgacatttagcaaagtgactttatcagaagctcaaacgtatggtaatggtacaggtagcggaaatgctgttagcgacaaggacttgatcaccaaatcctaccttgatgccgcattaaaagactttaagtttaatgtggaatatggtgrtmagaaagtccaaatcggtcgtggcgatacgttgaagtttaatgctgggctgaatattaaagtagagttagctcaaaatggtactacacaaccaagtgcgggtagttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatggtgcaggtacaaatggcggaaatagtacaagcagtacagcttcgtcaggagctactccaagtacgacaacagctggcacagcaagcagtacaacatcgaacacyacwgcggtggtgacgattggtacgactgaggacttgacaggyttgaaatctgcygagtttaacggcgawarcggtaacacgactcacattaccggcaatgaaattgtgttgaaagatcaggcaggtaacgctcatacacaaacggcgacatcgcaaatcatcacggataatacagatcccgataaggaaaaagcggtggtgacaacggctgagggcgtgacaatgtctgtggtcagcgatgatcaggttttggtcaatgatcaaacagcagaagcgaatgttttaagcaatggcaagcacacgacagaagtgaaagcaggtgaaattgctattaaggataaagtgggtcaagatgtcgtgagcttgaaagtggcagagggtgaaaacggtcaagatggcaagggagctacgcttgcgtttgctaaaggcactgacggtaaatcgggtacaggcgtaatcatgggcttgaaagacctagatgccacggctgacggttcaagtgcggcgaataaaaactatgtggatgaaaaagtgtccgacttagatagcaatcgtccgtttgacttctatatccaagagggcgatgactataccaaagttgtcaaaggacgtgatggtaagttctatgatcctaaagatttagagggggcgaagtatgatgcagaaagtaaaaaatacattgctcaagatggacaagatgtgacaccagagtcggataaggtgattattcgtgccgagccgactaccgcacctatcgggatgaataacgtggcgagtggtttgggactggcagatcctgaaactgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagtgccatgcctgagggtgaggataaaaagaaacttcaaactcaattggaggaaaacaagaaacagcttgaaaaagctaaagaagagctagggaaagcaaaaactgctttaaccgaggctcagacagaattaacagaagccaatgaagcttacgagaaaaactacgagggttatgaaaaagttgctgacttagtgaaacctgatagccaagcggatttaaccaacgtagccaccattgctgacgtgcaagcggtagcgaaatcgggcatgaagttcaagggcaatgatggtatggaggttcgtacgccattaagcgaaaccttagcaattaaaggtgaagaaaatgcaagtgacgagaagtttaacagcracmwcacygctgccggcaatatcaargtggaaatggcacaagatggcaaaggcttagaagttaaaytgtctgaccagttgaaaaacatgacwtcctttgaracwcgtgaagtgaacggtaagaaagcccgcttggatagcaacggtttacaagcgagcagtccagacagcgaaacttttgtaaatgcacagggtacccgtattgcgggcaaaggaaatcatgccggtcaatcggcaagttacaccctcgatggcgtggcgatcacaggtaagaacggaagcgtgcagttgaatacgaccgctctttcctttgcaaccactcgagaccaagctggtaaacctgtcggtacaggggttatccgaggtctgaaagacttggatgcccatgctaccggtgatatggcggcaaataaaaactatgtggacgaaaaagtgggtgctgccgttaatcgcctagataatgtcatcagtaccaacaaccgaaccttacaggcgggtattgccggtgcgaatgcggcggcagcattgcctacagtaacgatgccgggtaaatcgaccattgcgttgtccgcagggacttacaaaggcagaaatgcggtagcgataggctattcacgtctaagcgataatggtaagataacgctgaaattacagggcaacagcaactctgccggtgatttcggcggtggcgtgggtgttggttggacatggtagtctagtttaaccgctataaaaaagcagtgagtaatcactgctttttttatgataaaagtttcaccgctctttttagtttttgacgttcgacaaaatcgaaaagaaaatcctgttaaattaattacccttgataatgtccgacgcctagctcgtcttctttacgagtgcggttaataacgacttgcggagattgaacaatacgtaaccccatttcatcttcggtacgaactacctcacctcgcagagaattggtatagacatcagtaattttaatatctacaaacttaccgatcatgttaggcgttcctgcaaaattaactatacgatttgtttccgtacgacctgttaattccataatatcttttttcgatggaccttcaaccaatacacgttgctctgtccctaacattgctcgactaaattgtgctgcttgattgttaatgcgttgttgtagcaaatataggcgttgttttttctcttcttccgttacatcatcaggcatatctgctgccggcgttccgggacgagcagaataaataaagctaaagctcatatcaaaattcacttgagcaattaaattcatcgtgtcttcaaaatcctgatccgtttcccctggaaacccaacaataaaatctgaactaatctgaatattcggccgcactttttttaatttgcgaataattgatttatattcaagtgcggtatgatttcgcttcattaaattcagtacacgatctgaaccgctttgcacaggtaaatgtaagaaactcaccaattcaggcgtatccgcatatacatcaataatatcatcagtaaattcaattgggtggctggtggtaaaacgtaatcgatcaattccatcaatagaagcgactaaacgtaataactcagcaaatgaacaaataccgccatcatgtgttggtccacgataagcgttcacattctgccccaataaattgacttcacgcaccccttgctctgcaagttgtgcaatttcgaataagacatcatctacgggacgacttacctcttcacctcgagtataaggcactacacagaatgaacaatatttattacagccctccatgatagaaacgaacgctgtcggtccttccgctctcggttccggtaggcgatcaaatttctcaatttcaggaaaacttacatcaaccaccgcactttttccaccacgaatttgattaatcatttcaggtaggcgatgcaatgtttgtggcccaaatacaatatcaacataaggtgcacgtgaacgaatatgctccccttcctgtgaagccacacaaccgcccacaccaattaccaagctcggattttgtttctttaattctttccaacgacctaactgatgaaacactttttcttgtgctttttcacgaatagaacaggtatttaatagcaatacgtctgcttcttccggtacatcagtcagttctaaaccatgggtatttaaaagcaaatctgccattttcgaactatcatattcgttcatttggcagccccaagttttaatatgtaatttttgtgtcatgtcagtatttaaaattaatatctaagtaaaaaatcagtcggtcattttaccgagttgttgtagctgttgccagctaaaaatcagattttattttttaaatttaaccaataacgctaaaatagcgaaaattagtctgtggagaaaacacgtatgcaaaaagatattattgttgttggtggcggtatgattggtgcggcttgtgcgacaggattagctcaattgggattacaaatccacgtcattgaacatcattctctacctgaatttgattcgacatcggagtatgacattcgcatttctgcaattagtgctgcatcagttaatttattgaaaaccctaaaggcatggcagcatatcgaaaaaatgcgtattttcccttatcgaggactggaaacttgggaaattgaaggttttgcaacccaatttcactgccaagatttacagttagcggaacttggatttatggtagaaaataatcttattcaactaggattatggcagacattttcttcctaccataatattactaccaacgtggaaaatgcgattaaaaatgttgaaaagtgcggtaaaaattggcgtatttttttatccaatggagaaagttatcaagcacctctcatcattgcagctgacggtgccaattcacaattacgccaaattgcaggcataggtttgacaggctggcaatatcgacaagattgcatgctcattttagtgaatgtagaacaagatcaacaacatattacttggcaacaattttatccctccggacctagagccttgttaccattacaaaataagcaagcctgtttagtttggtatgacagcccacaaaaaatacgtgaattaaaacagctgtcaaatgaaaaacttgcagaagaaattcatcaagcatttccccctagactgggcaaaataaacgtacaaaaatttgcgacttttgcactaacacgtcgtcatgcacaagattatttcaaacaaggtattgttttagttggcgatgccgctcacacgattaatcctcttgccggacaaggtgtcaatttaggttttaaagacgtcaaagtcctgcttagtgtaattgaaagtgcggtaaaaaataatgaagatttttcaacggatcatgttttacaacgttatcaaaaccgacggaagcctgataatttactgatgcaatcgggtatggatttgttttataaagcctttaaagaagatagcatgccattaaaaatagctcgtaacttggcattactgggtgcaaacaaaatcacgcctcttaaaaaacaagcgttgaaatacgcacttggtttgtaaaaaatcacctaaaaatgaaatcatcactttcaattatgagctaatcgctatatcattagccattcaaaactaagggcgcttgcaattttattgtgggctttttatttctactcaatacctgaacaaacgcaggttcattagggagaaaaccaaagctagtggaaaatacagttcaaaacaagcctattattgagcttcgttctcttactaagtcttatgatacaaaaaccattatcaataacttcaatttaactattaataacggtgaatttttaacaattctaggtccgtcaggttgcggtaaaacaacagtgttacgtttgattgccggctttgaagagttaaatgaaggtcgtattattcttgatggtgaagatgtgacggatataccggcagagcgtcgtcacataaacaccgtattccaaagttatgccctgttcccacatatgacgatttttgaaaatgtggcctttggtttacgcatgcaaaaagtaccgaatgcagacattaaacctcgtgtaatggaagcattacgcatggtgcgtctagaagaaatggcggatcgtaagccaactcagctttccggcggtcaacaacaacgtgtcgccattgcaagagcggtagtaaataaacctaaagttttattgcttgatgaatctttatccgctcttgattataaattacgtaaagaaatgcaaaatgagttgaaagcattgcaacgtcagttgggaattacctttattttcgttactcacgatcaggaagaggcattaactatgtcagatcgtattatcgtaatgaacaaaggcactatccaacaagatggttcaccacgtgatatttacgaggatcctaaaaatctatttgtggcaaaatttatcggtgaaatcaatatttttgatgcgataattattgagcgtacagacgaaaaaactgttaaagccaatgtagaaggtcgtgtttgcgatattcatacagagttgactgtccaaccaaatcagaaattaaaaatcttgttacgtccggaagatattataattgaagaacttgatgaaaatgaaagttccaaagcaattattggacatgttgttgatcgtagctataaaggcatgacattagaatcaagcatcattcttgatcataataaaatgaaagtattggtgagtgaattctttaatgaagatgatccgcatatcgatcattcagtgggtcaaaaagtggcactaacgtggcatgaaggctgggaggttgtactggacgatgaagatgaacagtaataaatttcaaaacttaactgttagtgtcattttcggctggttactcttctttgttttagtaccaaacctgctagtcttaacagttagttttttatcaaaagatagcagtaatttttatgctttgccttttagcttggaaagttacgcaaacttagttgactcacattacgccaaagtaatgtggaattcactccgtatgtctgcgattgcaactgttatctgtttacttgtaggttatccttttgcattttttattgccaaaataaaaccctcataccgtccatttttgctattcctcgttgttttacctttttggacgaattcgttaattcgtatttacggaatgaaaatctttcttggtatgaaaggtattttaaacaataccctaattgcaatcggtattattgacacaccaattcgtatcttgaataccgaaactgcggtaatcattggattagtttacatcttactgccttttatgattttaccgctttacgctgctattgaaaaactggatcttcgtttattagaagcggcaaaagatttgggagcgaattcattccaacgttttattagaatcattattccattaacaatgccgggaattatcgcaggttgtttgttagttctattacccgcaatgggaatgttctatgtgtcagatttgcttggcggtgcgaaagcagccctagtaggtaatgaaatttatgtccaattcttaaaaataagaaactggcctatgggttcagcaattagtatagcacttactctactaatggctttattaatttttatttactataaaacaagtaaattattaaataaaaaaatggagttggaataatgagtcgtttactacgtaatatctttttgtttgtggtatacgcttatctgtatatcccgattattattctaatcagtaattcatttaacaatgatcgtttcggtaatacttggaaaggtttcggttttcaatggtatgagcgtttattcaacaacgatactctcattcaagccgctattcattccatcactattgcattttttgcagcctcattagcaacaattattggaacattaactgctatcgcactttatcgttatcgcttccgtggtaaacaggctataagcggaatgctgtttattgtgatgatgtcgcctgatattgttatggctgtctccctacttgcattgtttatgatagtaggtatctctttaggattttggtcattacttttagctcacgtaacattctgtttgccttatgttgtagtcagtgttttctctcgtctaaaaggttttgataacaaaatgttggaagcggcaaaagatttaggtgccggtgaagtaacaatattacgcaagatcattttaccgttagcgttgcctgccattgtttcaggttggctacttagctttaccatttcattagatgatgtagttgtgtcctcatttgtcagtggtgtaagttatgaaattttaccattaaagattttctccttagtgaaaaccggggtaacccctgaagtcaatgcactggcaacactgatgattattttctctttaatattggtaatactcagtcaacttgttgccaaaaaagggaaataataatattccaaaactgtgaaataatatttcacaaatgatcctatatcacataaaataacacgccctactttcggtaaggcgtttttattccttcaacaccgaagtatattccgcatgttaaaagtgcggtcgttttttactcttatattggagaacaatagaaatgaaaaaattttcaggtcttttcacactgggaatgatcgctgtagctctagcggcttgtaatgataaagatactcaaaaagcagagactcaagcacctgctgcttctgcaggtgatactgtttatctttatacttggacagaatatgttcctgatggattattagaaggcttcactcaagaaacaggcattaaagtcaaccgttcaagtctagaatctaacgaaacaatgtatgcaaaaattaaaactcaaggtgctgccggcggttatgatgttattgctccatcaaactactttgtttcaaaaatggctcgtgaaggtatgctaatggaattagaccacagcaaattacctgtcatcaaagaattaaacccagattggttagacaaaccttacgataaaggtaacaaatactctttacctcaattgttaggagcaccgggcattgcatttaatacaaatgaatataaaggctctgacttcacatcgtgggctgatttatggaaacctgaatttgccggtaaagttcaattattggatgacgcacgagaagtattcaatatcgcattgttaaaattaggacaggatccaaatacacaagatcctaaaattatcgaacaagcgtatgaagagttattaaaattacgtccaaacgtactatctttcaactcagataacccggctaattcttttatttcaggggaagtgagtattggtcaattatggaacggttctgtacgtatcgctaaaaaagaaaaagcacctttagatatggtattcccgaaagaggggcctgttctttgggttgatacgttagccattccatcaacatctaaaaatccggatgctgcacataagttaattaactacatgctaggtgcaaaaacagcagcacaactcaccttggaaattggttatccaacctctaatatcaaggcattagaattacttccggctgaaattactcaagatccggcaatctaccctacagctgaagttttacaaaacagttactggcaagatgatgtcggtgatgcagttcagtattacgaagaattctatcaaaaattaaaagcggcaaaataatctttgcacacaaaagaaatgctcccattggagcatttctgttttgaaaataagcttaagctaaattcccaactaaatttttcacaaattccaaccgctctttatgtgacgtcaatgacttactaaacctaaacttagtcggtccgtcaaatttaaatacagtaggctgagactgaattaattgcacaaatttcatcggatcaagttctgcattttcagaaaactcaataaatcccccattaattgtgctatcaattttgacaatttttaaggtttttgccagcaaacgtaactcagcaatttgcattaaattcttacctgcctccggtaataagccaaaacgatcaatcaactctactttcaattcatctaactctgcctgattttccgctccggcaatccgtttataaaaagataatctcatattcacatcaccaagatattcttccggtaataatgcaggtacacgtaaatcaatctctacttgctgttgtgttaaagtatccaaagaaggttctcgcccttcttttaatacagcgacagcattttccaataattccatataaagcgaaaaaccgatactttcaatttgaccgctttgctcatttccgagcaattcaccagctcccctaatttctaaatcatgggtagccaaaataaatccggcacctaaattatctaaactttccagtgcctctaaacgcttaacggcatctttggtcattgcttttggatgaggtgtcaacaaataagcatatgcctgatgatgagaacgtccaactcttcctctcagctgatgtaattgggctaatccaaaattatccgcccgttcaataataatcgtgttagccgttgggacatcaatccctgtttcaataatagtagagcaaaccagtacattaaaacgctgatgataaaaatcggacattacacgctccaactctctttctcgcatttgcccatgcccaacaaccactctcgcttccggtacaagtgcggtcagtttttctgcacaattttcaatacttgccacatcattatgtaaataataaacctgtcctccccgtaaaatttcacgcaacacagcttctcgaataatcaaatcgtctacctgtcttacaaaggtctttatgctcaatcgtcgtgccggcggtgtggaaataattgataaatcacggatgccactcatcgccatatttaatgttcgaggaataggtgttgccgttagggttaaaatatcaatattggttcgtagctgtttgattttctctttttggctcactccgaaacgatgttcttcatcaataatgagcaaaccgagatcgctgaattttacttctgactgaattaatttatgcgtaccgattaaaatatcaattttaccttcattcaagtgttgtaaaatttgtttctgctcttttgccgttctaaaacgtgacaacatttcgacattaaccggcaaattggcaaatcgatctttaaaattttcataatgttgctgtgccaataaagtcgtaggaaccaaaaccgctacttgtttatggttcatcacggctaaaaatgccgctctcattgccacttccgttttaccaaaccccacatcaccacaaactaaacgatccatagctttttcttggcacatatcagaaataaccgcattaattaccattttttgatcgggtgtttcttcaaaaggaaacgtggcagcaaattgtttaaattcttctttatcatattgaaatgcaaagccttttttaacttcacgttgagcataaacatccagcagttcagcagcaacatcacgaattttttctatcgccttatgtcgagcctttgcccaactatcattaccaagtttatgtaaaggtgcattttcatcagatcctccaacatagcgactaattaaatgcaaagaggtaacgggtacataaagttttgaattattcgcatattccaataataaaaactcagctttaattccaccattttctaaactcaccaatccaccatagcgtccaacaccatgctctaaatgcacaacaggttgtcctatttttaattcagcaagattgcgaatgagtgtatcgggattggcaactctacgtttattacgctcacgttgttgcactcgctctcccaataattcagtttcacaaataatggcaaccttatcctcattatcaataataaatccatgttctaaactactgatgagcaggcttttagctggcttatctttttcacctaaatcctgaatttgcgttggtttgagctttaaaggtaagagtaaatccaataatgtttcccgacgcccttctgtttctactgaaaaaataacagttccgtcaaattcctcaataaactgacgcaatttttgcaaaggttctttttgttgtacttgaacggttaattccggcaacggctgcacaggcaaatttttctgacgaacagaggaacgatcaaattttttgctttttaaactcaatcttggataattttttaactgccgattaacttcatcaatacgtaaccacaatttttccggcatcagcaacggacgcatcggatcaacacgacggctttcataacgttgttcaatatcctgataaaaacgttccgcttgcggcacaatttgttcaaaatccacaaacaacgtattgtcaggtatgtaatcaaacaacgtcgccatttgattaaaaaagagcggttgccaatattcgattccggaaactagagttcctttactgatttgttgataaatatgttcaggatctcgtctaatttccgcaaaagtttctctaaattgactacgaaaaaattcaataccttttctatctgttgggaactcttgtgcaggtaataaattaatacgttgaatttcctctaatgtacgttgcgtatctacatcaaaagtacgaatactatcaatttcatcatcaaaaaaatccaatcgaaaaggcaccgcacttcccatcggaaataaatccaataaagcacctcgtactgcaaattcgccatgttccagtacttgttcgactgctcgataaccggcattttccaactgtaaacgaaatctatcgatatttaatcgatcacctcgttttatcaataatacattgtgttgtaaaaattctgccggacaaactcgttgcattacagtcgtaattggtgcaataaagatacctttgttgctatgttgcaactgaaacaaggcacttaagcgagctgaaataatttcttgatgcggcgaaaaattatcgtagggtaaagtttcccaatcaggaaaaaatgtaacaggttgttgagtgaattcagttaaaattttttctaaacagaccgcacttttaacatcaggggtcatcacaaaaatcaacccatcatatcgccgtacaatttctgcaatcacaagactatcagccccctgtaatacattacctagaagtttatgctcattgggctgggtaggtatgtcaaaattaaaatacatcatattcaaatggatttatgttgaaaagttgccatgtaatttgcactgacatcttgatttaaccaaaattttccggttaaaagattgtaatgataaccacaaatatttttacagactaaatttgcttggtcagtccaatgcagtaactcagccggtttgataaatttatcgtaatcatgtgttcctttcggtaacattttaagtatatattctgcacctaagaccactaatgcccatgctttaaatgtgcgattaatagtcgaaaaaaataagacaccattcggttttaataaagctcggcaagactgaatgatggataaggggtcaggaacatgctccagcatttccatacaagtaatcacatcaaatttttcagcgtaaagtgcggtttgtttttgtaaaaattcttcaacagtaatttgctgataatctatgaccagtccttgttccttggcatgtaaacgagcgacttcaagaggagcaacggtcatatcaattcctgttactattgccccttgctttgccatagcctcagacaaaataccgccaccacaccccacatcaagcacttttttttccgttagtccgttagcttgctgttggatatattgtaatcgtgtcggattaagttgatgaataggtttaaaatctccattcggatcccaccaactttttgccattttttcaaatttttctaattcttgcggatcaagattttgcatttttatcagtccgtatagcagtaaaaaacaattacgctattattccttaactgcgttaaaaattcactacaaaatttcgagaaaatcagaagttatgctataatctcgccaatttttcgtacctaattaggaaatctcaatgactgattttacccccaacgttactcctgtgagtatagaagaagagcttaaatcttcgtatcttgattatgcgatgtctgtaattgtcgggcgagctttgcctgatgtacgtgacggtttaaaaccggtgcatcggcgtgtgcttttttctatggatcaaagtagcaatacttacaataaagcctacgtaaaatctgctcgtgttgtaggggacgttatcggtaaatatcatcctcacggtgatagtgcggtgtactatactattgttcgtatggcacaacctttctcgttacgctatatgttggttgatggtcaaggtaacttcggttcggtagatggtgatgcaccggctgcaatgcgttacaccgaagtgcgtatgcaaaaaatcacccaagaattactcaccgacttagataaagaaacagtggatttttcgccaaactatgatggaaaagaaatgatccctgatgtcttgccaaccaaaattccaacattattggtcaatggttcttctggtatcgctgtgggtatggcaaccaatattccgccacataatttaaatgaagtattggatggctgtttagcctatgtggataacgaagaaatcagtattgatgaactaatgcagtatattcctggtcctgacttccctacagccgctttaatcaatggacgtaaaggaattgaagaagcatacaaaacaggacgaggaaaaatctatgttcgtgcaaaagcggaaattgaaactaacgataaaggtcgagaaaccattgttgttactgaaattccgtatcaagtcaataaagcaaaattagtagaaaaaattgcggaactcgtgcgtgaaaagaaaattgaaggcatcagtaatgtacgagatgtgtcaaataaagagggtaaccgtgttgaagtagaagttaaacgtgatgcagtcggtgaggtcgtacttaataatctgtatgccttaacccaaatgcaagtgacgtttgggatcaatatggttgccttagatcatggtcaaccaaagctattaaatttaaaacaaatcattgaagcatttgttcgccatcgccgtgaagttattactcgtcgcactgtatttgaacttcgaaaagctcgtgagcgtgcacatattttggaaggcttggcaattgccttagcgaatattgatcctgttattgaattaattcgtgcctctaaaaccgctgatgaagctcgtgtcggtttattatctcaagcttgggaattaggtaatgtagcaacaatgctcagtgcaacagacgtagatagttctcgtccggataatttggctgataacttaggcatcatcgacggtaaatactatctttccgatgaacaagctcgtgcaatcttagatttacgtttacaacgcttaacggggcttgaacacgaaaaaattgttactgaatatcaagaaatattaattgaaattggcaaacttttacatattctaaacagtgcggatcgtttgaaagaagtcttgtgtgaagaactggaaaaagtaaaagaagaatttggtgatgcacgtcgcactgaaattacatcggcatccggcgatattaatttagaagatcttattacccaagaagatgtcattgttacactttctcatgcaggttatgtaaaatatcaaccgcttacagactatgaggcacaacgccgtggcggtaaaggtaaatctgcaactaaaatgaaagatgaagattttattgagcgtttattagttgccaatactcatgacactattctttgcttttcaagtcgaggcagattatattggttaaaagtatatcaactaccgcaagcaaatcgaggggctcgtggtcgtcctattgttaatattctcccattacaagaaaatgaacgtattacggcaattctaccagtggctgcctatgaagaggataaatttatcgtcatggcaactgccggagggcttgtgaaaaaaattgcgttaaccgaatttagtcgccctcgttcaagcggtattatcgcgcttaatttacgtgatgaagatgaattaatcggcgttgatattacagatggtaccaatgaaatcatgctcttctcatcacaaggtcgagtagttcgttttgaggaaaattcagttcgagcaatgggacgtttagcgacaggggtacgaggtattaaactggcattaacaaatgatatttccgatgatgaaagtgcggtagaaattgaagatatttctgatgaggatacaaaagaacctcttgatctcaatgtagataaagtggtgtcattggttattccaaaaaatgacggtgcaattctaaccgctacacaaaatggttatggaaaacgtaccgcactttccgagtatccaaccaaatctcgtaatactaaaggggtcatctcaattaaagtcagtgacagaaatggtaaagtggtcgctgcaacgcaagtagaggaaaatgatcaaattatgctgattaccgatgcgggtacattggttcgtacgagagtgagtgaaatcagcattgtcggacgcaatactcaaggtgttcgactcattcgaacagcggaaacagaacaagtcgttagcttagaacgagtttgtgatactgatgaagatgaagaaaatatcgataacgattttgaatagagaacagactaaatcatcataatttcaagggcgattatcgccctttctttatgtccaaaaaatatgactctctaccttatttatacccacttaatatgtgcttttttagcttggcattactgattattcgagggctgatacaaatggataataaatcagcaaaaatactcaatccgctcttttttcctgctttactctgtctaagtgcggtcgttttttctcggattttttcataattgaaaaatcaataaaatatgtcattatttaatccctcatttctctacaaaaaagctattttccctttttggtaaagcaaatttttttgctatactcgaacactgcttttattaggagaaacaatatggaacaaatgccgaattgcccaaaatgtcagggtgaatacgtatatcacgacacaattaattttgtttgtcctgactgtggaaatgaatggtctgacaatgaaattgaacaacaagacgaagatcaactcatcgtaaaagatagcaatggaaatatattaactaatggcgatgatgtgcttttaattaaggatttaaaattaaaaggatcttcagaagtactaaaaaaaggcacaaagtacaaaaatattcgtttagtaacaggtgatcataatgttgactgcggcaaattattactaaaatctgaatttttaaagaaagcttaaattataactatcatgtttatctaaattggagttgttatgaaaaataaaattctcggcagtgcattaatgatcgccggcacaactataggtgcgggcatgttggctatgccattaacctcagccggcatggggttttccatgacgttagtgctacttgcaggattatggttattattgacctataccggcttgttgtttatggaagtttatcaaactgcaaaagaaaaagatgtaggcgttgcaactcttgcagaacagtatttcggtttaaccggacgttttttggcgactattagcttgctcgttctactctatgccttacttgccgcttatattaccggtggcggctctcttttatcaggccttttaacgggtattggtgatgaaaaacaaacttctcaaatctcaatattactctttactctaattttaggtgcatttgttgtgattggtattaaaggggttgacggcttaacccgcctcttgtttatcggaaaaatcattggctttattgcggtcttattaatgatgttacctaaagcaaaattagaaaacctaggggcaattcctttagataatctattggttatttctgcaattccaattttctttacctcttttggcttccacgtcattatggggagtatcaatagctaccttgatgcagatattcgtaaaatccgtttagccattattattggaacgttaattccattatttgcctatttattatggcaattcgcaacacatggcgtattaagccaaactcaatttgttagcctattaaaacaagatcctaccctaaatggattagtaaaagcgactagtcaaattactggaagtagcctattaggtgaggtagttcgcctattctcatctcttgcattaattacttctttcttaggtgttgcaatgggaatttttgaaggggttggtgatctattaaaacgtattaatctgccgacaaatcgcccgatactggcacttttaacttttattccgccactagcctttgctctattctatccaaacggttttatcaccgcactaggttatgccggcattttatttgccttctatgggctacttcttcctgttgctttagcttggaaagctcgtcagttgcatcccaacctaccttatagagtcgctggcggtaatcttgcattagtcatcgcatttattatgggcatcgttattatcgttatcccgttcttaatgcaagaaggtatccttcctactgttgccggataaattaaaaagagcggttaaatttttataaattcaaccgctctttctattaaattttaaaaataatgcctcacaattcatattatgaagtgttacgtttatctaaaagcaatttagtctactattttttcggtaaaacgttcaattttcgcacccaatccacgtaattttttttcaatatgctcataaccacgatcaatgtgataaatacgatcaacgatggtttcacctgtggcaatacaaccagctaagacaagactgatagaagcacgtaaatccgttgccataacttctgctccggataaatattcaacaccatgacaaaatgctgtgttaccttcaatctcagcctttcctcccatacgaattaattcaggaatatgcataaaacgattttcaaaaatagtctcggtaattttacttgaaccctctgcaaccatatttaataaagtaaattgagcttgcatatcagttggaaaaccaggataaggttcagtacgtatatttaccgcttttggtctattaccttgcatatccaatgtaatcgtattttccgtgacttcaattttagcaccggcatcacgcaatttatcaattactgcatctaaagttgatgctttagtatttttacaaatgatacgtccgccggaaatagcggctgcaactaaaaaagtaccggtttcaatacgatcaggcacaatactatgctcacaaccgcccaagcgttcaacaccttctatcgtgataatatctgaacccgcaccgctaatttttgctcccatcttatttaaaaatgcagcagtatcagtgatctcaggttcacgagctgcattttcaattactgttatgcctttcgctagagttgcagccatcataatagataaagtcgcaccaacacttactttttcaataacaattcgtttaccgattaattgaccatcaacaaaagccttaacataaccgtcttccaatacaatttttgctccaagtcgctccagcccgctgatatgtaaatcaacaggtcttgcaccaatagaacaacctcccggtaatgaaacttgcccttgtttaaaacgagatactaaaggagccaatgcccaaatagacgcacgcatcgtcttaaccaactcataaggagctacaaaatgattaatatttgaagcatctaaatgcaccgcaccttgttcatctcgataagttaccacacctaattgttgcagaatttttaacgtggtatcaatatcttttaactcaggtacattagttaatttgacaggctcttcagctagaatggccgcaaacaaaataggtaaggcggcatttttagcaccggaaatattcacttctccatttaaacgagactgcccataaacacgaaatttttgcatatgttacttcctacttatgctacatattcaataaacgatcacgcttccactgttcagtactgaatgtttttattgttaacgcatgaatcgcaccggatttaaaatgtgccattaaaggtgcataaatagtttgctgttgttttagtctggacagttgtgcaatttcatcgtttacaacaatgacaccaaaatgtgcattttcaccctgaacatatacttcatcgagattcaatgcttcctttaaaatttgctcaatttgctgagtttccattaatattttccactattgtaaaaaaggcttaagccaatcagataagccaaaaagatctgccaaaatttccaattgaattggggcattatgaattttttgtgaacttacttgtttttcaagctcattaataaaatcacttagcaaagcaaaaccagcactatcaatgcgattaacttcactgagctcccaaacaagttgctgaccaacaagctccgcacttgataaaagttcatcacgttgttgcaaaaaaggaagcaatgtatctcgtgataacgctcccataattcggagcgtcatcttatcactatttttttctaatgcccaattcagattgttctttttcatacgttatttactactaataataattggttgtttagaaaattcttccatctcatcaatcaaagtttctataccttttttgcgtaaaataggtaaccattcctgtcttgttgagtgaaccgtactcacgccgttagcggacatatcatacacttgccacttacctgatttactgttcttacgccaataaaactctaaatcaataggtgcaacattgccactttgcagtattttaaccggcacattcatttgatctgccgttacattaatcggctttaatacactaattttctgattactataaagcgttaatgctttggcatattgatattcgataaatttatcaaataccgcaaagaattttgcacgttgttccggtgatgttgatttaaaataaggccctaacactaaagatcctgcataatttacatgagcatagggcatgagtccttgacgtacgatagtacgcaaataattaggatcttgtttaatcttactttggttagtatcaatggctttaaataaacgctcagatacatcaagcgttagttcataaggtgtttcttccgccatagcttgtacagcaaaaagtgcggtcattgccacaattattttaaaaaatagtttttttaacataaatattagctcctaaatctacagtgtataaaaaattattgaacatccgattccaattgcttttgagtgcttttattttctttactgccatataagaattgcccgacaagatcctccaataccatggctgatttagtatctacaatacgacttccctcttttaacatggaagtttcaccatcatcaaatccaacgctaagggaaatatactgctcacctaacaaacctgaggttttaattgataatgaactgttatctggaatttcattgtacttttcatctatagcaattttaaccagcggtaaataggttttatcatcaagttcaattgatgatactctgcctattacaacgccaccgactttcaaaggagctctaactttaagtccaccaatattatcaaaaacagcataaacttgataagattttgcttgattaaacccttgtatattcgcaactcttaatccaagaaaaaccaatgccccaataccaattaataaaaataatcccacccaaaattcatatttaactgtttgtctcataaaaaatccttaattttctaccgcactttatttatgaacctgcaccaaacatcagtgctgtcagcacaaaatccaatcctaaaacaacgagagaagcatgtaccaccgttttcgttgtcgccttactgattccttccgatgtcgggatacaatcatagccgttgaataatgcaatccaaacaacagcaatagcaaaacataaactcttaataaaaccatttaataaatcatagctccaactgaccgagttttgcatcaccgaccaaaaactcccagcatccacacctttccaatccacaccgattaaagaaccgccccaaataccaattgcggtaaaaataacggcaagaatgggcatagaaatcacacctgcccaaaaacgaggtgaaataactcgacgcaaaggatcaactgccatcatttctaagctggataactgctctgttgctttcattaaacctatttcagccgtaagagccgaaccggctcgaccagcgaataaaagtgcggttacaacagggcctaattctcgtaacaatgataatgcaactaattgtccaagacttgtttctgcggaaaaatccactaacaccacatacccttgcaaccccaacaccatgccaataaataaacccgataacatgatgattaacaaagattgtacacctaatacataaagttgtttaatgagtaaagggaaatgcttcctcatctgttgtttcccaaccaatgcaccaaaaagcataaaaccggctcgccctaaagaacgacaaaaatccattccccatctacctaaagatgaaataactcggatcatgaaaacaactcctgtacatagtcttgtgcaggaaaatgaaaatgaacaggtccatcttccttaccttgaataaattgcacaacttgcggatctcggctttgtaaaagttgctccgcacttccttcagcgatcactcttttatctgcaataatatacgcataatccgcaatacttaatacttcctgcacatcatgagaaaccacaattgaagttaatcgcaacgcttcatttaaacgtttaattaagctaataatcactcccatactaatgggatcttgccctgcaaaaggctcatcgtacataattaactccggatcaagtgcaatggtgcgagctaatgcggctcgtcttgccataccgcctgacaattccgacggcattaaatttgccgcaccacgcaaccccacagcttccaatttcatcaacacaatttgacgaataagtttttccggtaaatgtgtatgctctcgaataggaaaagcgacattatcaaaagttgataaatcggtaaataatgcgccggactgaaataacattcctatgcgttgacgaactcgatataactcactattggacattttacaaatatcttgctcatcaaacaaaatttcgcctttttcaggttgaagttgtcctccaatcagttttagcaacgtggttttaccaatgcctgacggtcccataattgcagtaattttgccttgctgtacctgcaaattgagattgtcataaataattcgattacctcgcttaaaagttaggtttctgacttctattaaaggtcttgtcatagtttcttcattactctacttatatttgtacaaaatgagatcggatattccacgaatttccggtcattgtcaaattaaattatgatgattttcaaccgcacaatccaaacgagatgtctaagttaacaccccagactttaatagattattacatgcttttttaaaaactatgctatgattacgcaatttttgtcaaacacaaaacaatataaggattttatgcatattcgctggaatattattttatcggtgatagctcttgttttactcgcttggttttatactttacagccaaatgataatgaactcagtcagcttataaagtcaagtacacagccggaatacataggagaaaagatgtcaacctctgttttttcgccaacaggaaaaaaacaatatttagcgacagcagataaaattgaacactacaatgaggatagacgcacagaatttcaccaaccgctggtctatttatttgatattgatgatgaaaaattcggtacgcaaagttggaaattaagtgctaaaaaagctaaattaacaaaaaataatatgctttatcttgatggtaacgttattgcagaaactttattggataatgctaaattacaacgagttatgacagaaagtgcggtagtaaatttaactactcaagacatcacctctgacacgatggttactataaaaggtcaaaatttcagctccaccggcttaaaactgaccggaaatttacaacaacaaattgcaaccttaaaagaacaggtaaaaacccattatgaaatcaacaacaaataagtatttattaattaccgcacttatgatgacttcaatatcagctttagccctaaaagatgatacaaatcaaccgatagatatcgtatctgaccatcaatcccttgatatggaaaactctgtggtaacttttacaaataacgtagtcattaaacaagggtcaattttaattaaagcgaataaagtcgttattactcgcccaacagaaaaatccaataaaaaagaaactgttgaggctttcggtaatccagttctctttaatcaattacttgataatggaaaacctgttcagggcaaggcgaataaaatccactatgatctcagtgccgaatttttaactttaacgggtaatgcggaattaaagcaactggatagcaaaattaacggtgaaaagatcacctatgatgtcaagaaacaacaactcaaagcaaatggagccggaacatccagagtaaaaacagtattaattccgactcaattcaataatcaacacaagaagtaaccgggtaaattaatatgtctatactgcatgcagaacatctcgctaaaagctataaaaaccgtcaagtggtttctgatgtaagtttaacagtgaactctaatgaaattgtaggtttactgggaccaaatggtgcgggaaaaaccacaacattttatatgatcgtcggtttaatacgccatgatcaaggaaaaattcacattgataacgaagatatcagtttgttgcctatgcacaaacgagcacagcgaggaatgggttatctgccacaagaagcctctattttccgacgattgagtgtttatgaaaatttaatggcagtcttggaaattcgtaaagatttaaatatgcaacaacgccgtactcgagctgatgagctgattgaagaatttaatatcggtcatatttgtgataatttgggacaatctttatcgggcggtgaacgtcgtcgtgtagaaattgcacgtgccttagctgcaaaccctaaatttattttattggatgaaccttttgccggtgttgatcccatttccgtaattgatataaagaaaattatccaagatttacgcaatcgtggattgggtgtgttaatcactgatcataatgtgcgagaaacactggacgtttgtgaacgagcttacattgtcagctcaggaaaaatgatagcaacgggtacacctgctgaagtcatgaataacgaacaagttaaacaagtttatcttggtaaagaatttaaattgtaattatgcttaaatttactgaattactctctcctgaaaatatccgtcaagggttaacttgtacaagcaaaaaaagagcttttgaaatcatatccagcttaattgctaaacaactttcagaacaaattgatggcttagaagcagatgaagttagtcttcaggaaaaagaaactctttgtaccgattctttactcaaccgagaaaaattaggcaattccagtttgggaaacggtatggctatgcctaaaggaagattacccctaggtaatacacctatcgcagtcttcttacaactgagtgcacctttaaaatatgatgcacttgatcatcgtgaagtcgatcttatttttgccttattatccccgacagaacattgttccaatctcgttcaagaattgccccatttagtagagcgtttaaaagacaaatctctaattaaacaattaagaaacgcacaaagtgcggaggaaatttggcaaatttttcaattttcagatagacaggcggaaacattaccaactactgaacaacaccatgctgaaacaaaatatcccgaggaagaataaaaatggagattatcattattagtggacgctcaggtgcaggaaagtccgtagcattgcgagcattggaagatattggctattattgtgttgataatctcacgatggatttagttcctcaacttgttgatatgttggaaaacaaacagcatttagtagcaatcagtttagatattcgtaacttacctcaagaacctgaaacattggatcacatcttaaatttgctgcaagaaaaatatccggtaaaaattattttcttggatacggatagaaataccttaattcgccgttatagcgactctcgtcgtttacatccgttatcggtccaaaatctgtctcttgaagcggcaattgctgcagaaaaagagcatcttgaacctttagtacaacatgccaatgtaattattgataccacaccgctttctccccatgaacttgctgaacgtttacgtgaatttttgcatggcaatacggaaaaagaattacaaattattgtcgaatcttttggatttaaatatggtattcctttagatgctgattatgtttttgatgtacgttttttaccaaatccacattggaatcaggaattacgcccaatgacaggattagaaaaaccagttatcgaatttatgcaaaaacatattgaagttgacaactttatttatcagacacgtaactatattgaaaactggttgccaatgttagaaaaaaataaccgcagttatttaaccattgcaattggttgtacaggcggtaaacatcgttctgtttatatcgctcaacaaattggtgaatatttccgagcgaagggaaagaaagtgcaaatccaacataaatcattggaaaaacatacacaaaataaataaccccaaacttaaattcggggttattttgtcagtaattatttaactcgttgtcccgcttttgcacctgcatcaacatcaagtaaatataaatccgcaccaccgttgcctgcgcttaaaatcataccttcagacattccaaacttcatttttcttggtgctaagtttgcgaccataatcacaaaacgcccctccaaatcttccggcttaccatacgccgctttaattccggaaaatacttgacgagtttcattgcctatatccagtataaatttcagcaacttattactttctggcactgcttcacatttcaaaactttcgctacccgtaaatccactttgaaaaaatcatcgatagtaatgctttcttcaattggctcaaactcggaaaatgctttattttctaccgcacttttccctgcggtttggttagctttcgcattttctatttttgaagcctcgatcatttcttcaatttttttcatatctaagcgtgaaaatagaggtttaaacggtgcaatttgatgatctaacaaagggcttgctacattttcccaagtcaattgcgtatttaaaaatgcttctgcacgtgctgctagatttggtaggacaggtttcaagtaacctattaatacgcggaataattcaatccccattgagcacacttgttgtagttcagcagtacgattttcgtctttggcaataacccaaggtgctttttcatcaacatatttattggctttatcagtaagtgccataatttcacgaatcgcttttccaaactcacgattttcatagtagtcggcaattaactctgactgtgcaataaattcatcgaacaacattttatcatctaatttattcgccaatttcccgtcaaaacgtttttgaataaaacttgcatttcttgaagctaaattaactaatttattcaccaaatccgtatttacacgctgtacaaaatcgtccaaatttaaatccaaatcatcgatacggctgcctaatttagcagcatagtaataacgtaagcattcaggatctaaatatttcaagtaagtagcggcttgaataaacgtccctcgagattttgacattttctcaccgttgacagtaacgtagccatgtacgaaaatattattcggtttgcgtaaactggctccatccaacatcgccggccaaaataaactgtggaaatacataatatctttaccaataaaatgataaagctcagcatggctctctttgctccagaaactatcaaaatcaataccgctctttttgccacagagatttttaaacgatgccatataaccaatcggtgcatctaaccacacataaaaatatttattgtcagtattaggaattttaaagccaaaataaggtgcatcacgagaaatatcccattgttgtaatccagcctcaaaccattcctgcattttatttgcgacttcttgttgtaaagaccctgaacgtatccattctgttaacatcgccccaaaagcaggtaaatcaaagaaaaaatgttcactttcttttaataccggcgttgcacctgatactgttgaacgtggtgaaataagttctatcgggctataagttgcagaacaaacttcacagttatcgccatattgatctgccgccttacatttcgggcaagttcctttcacaaaacgatcaggcaaaaacatcgctttttcaggatcgaaaagctgagaaatagtacgagttttaataaaaccattttgctttaatttatgataaattgcttcaactaactctctattttcatcactgtgagtggaatgataattatcaaaactaatgttaaaaccactaaaatcagccatgtgtttttgttgcacatctgcaattaattgctcaggttttacgcccatttgatctgctttaagcatgattggtgtaccatgagcatcatctgcacaaacaaaataaatttcattgccacgcattcgttggaagcgaacccaaatatccgcttgaatatgttctagcatatggcctaaatgaataggtccgtttgcatagggtaaggcacaagtaactaaaatttgacgtgaattcgttgacattaatttaacctttaaatatgaaaattttgttgttcatcttaccttattagtggtattttttccagctctcgatactttacaatcgtagttatgctatgatgaccgtagcaatttaacttgtttctttaggaaaaaagaatatgacaatccatttttcacataacctctctgaatcacaaaaacaacagttacaagaatgtttccgacaatttagtcatactactttacaaaaagatttaattagcttaggtgcggtcaaaaaaatcgaacttggcggcaatatgttacgcatagagttagtgatgccctttgcgtggaacaccggttttgcacaattaaagaccgcacttagcgataaattagaagcaatcacacgagcaacagaaatcaaatggttacttagctatcaaattgccactctaaaacgagcaaataacctgcctgctgtaaaaggtattaaaaatattattgcagtaagttccggcaaaggcggggtaggaaaatcaacaatctccgtcaatcttgcactggcattacaaactcaaggagcaaaagtaggtatcttagatgcagatatttacggaccttccataccgcatatgctaggcgttagtcagaaccgccctacttctccggataatcaacatatcgatccaattcaggcacatggcttagctgccagttccatcggttttttaatggagccggacagtgccacaatttggcgtggcccaatggcaagtagtgctttaagccagttattacaagaaacactttgggcaaatcatggtgaattggattatttggtgattgatatgcctcccggaaccggtgatattcaattaacgttatcacaaaaaattcctgttaccggtgctatcgtcgtaactactccacaagatattgcattacttgatgcaatcaaaggaatttcaatgttccaaagtgtacaagttcccgttcttggtattgttgaaaatatgtctgttcatatttgtagtcaatgtggtcatcatgaaacgattttcggaacaggcggggctaaaaaaatggcacaaaaatatcaaattaaactcttggcacaactaccgttacatattcaattacgtgaagatatggataacggtataccaactgttatttctgctctagaaagcgaaatatcacaatctttcttacaattagcagaaaaagtagctactgaactttattggcaaggtgaaattattccaggagaaattttattcaaagaagtaaattaatatccaagaaatttctagcgtcgggtttgtcctctcttgttcgggctatgatagcatttctctctaattcagcaaggacgcttaatagttgagttaatgctatagaaagaggggtattccgtgctgttgtatcaaacattccgtctcgtgttttaaagtcgatttttctatcgtgaaattcagttataacacctataacttgtaatgcaccctgacctatctaggctagcaacaacatcccccctctcggatataattcagtaattctagcctttctgcattcttttccctagttccctgaattttgcagcctgcttttttaattggtttatttggtcttttaagtcctgcttatgagttgatactccagcaaatccaacaaaagctatttttacctctattcaaaagttacataataaaaacaaatatattgattacttctattttgaagcagtttgcgagtaggtatttaaatgagaaaatttcaacgcatcaaattcatcgtgtataacgtattggtaaatcagtactaaattaccttgaatatgacaatctcgatgatctttccattctccaactaatgtgtgatcttgatagctttctggtaacggtaagcgatttaataaacagtttattgcagtcatgtatttttttccaattaacacattcggggagcgtttagctaaatcagttaaatctctagcaaactgttttgaatagctcacttttaatggcttcgttgacattattgacccattaagaatgcgttttgtaaactattcagcagagtaattttcaccagcttcaataaagaaactctctgcgttactactctctaattcatcaatagctgctagggtttctttatttgagcgaagataattcaaatcaatagggatagagcgtgtcttggcaatttnnnnnnnnnnnnnnnnnnnnnnnnnnnnnnnnnnnnnnnnnnnnnnnnnnnnnnnnnnataagcttcggttttagttcgatcaactgttctaaagctgatagaggaattcgtaagtaccatcatttttctcaatagtattacattgaaagactatcatagtaagaatgaagttaaaaatctacatttttaatgtgattagggattttcatttttaattgctattcagaagttttcaatgtatatttttgaatatagtcaaagataaaaacggagcgttacgccccgtttaatttatttttcactttcttccaattcgtctgccatcgctgataaaatttctctagaaagcaaaactaaagcacgataaaagggtaaatttgcatgcttttctacttggttaaaaaactgactagcacaaggtaacaaaaaaatttcaaatagttctcgctgggcttgaatggaatttaaattatcttcaacccaagaggcagttaaaaaaaccaacgcaaaatgatccgcactttctaccactgggcatcctcgctcttgtctaaacgaagaaaattcatccggattaattccataatcagagattttcattgaaataagtggcgtatcagtcataaataaacgctgatattctatttccagtgcgtttaaatccattggtatttgcaaactatctaacgcctctttactttgtttatctgtttccaaacaccaaacctgttccaaacctttttgttgtaaccaagaaaatacgtctgtcattataggatctgtcggttgacgataaaataaattaccgaacaatcggcttattaaggaaaaattactcatttgatctacaatcacgcaataccttccttttgtaacgctaaaagagcggtgagatttttcactgttttttctcttacttcttgcaagatatgttgcttagcttgttcatctaaaatgtgaatatcaccgaaaaaactatgatcaatatcagtaactccacaataattaaacagaccatcaactaagcaattttgtaatgattgtgcaaatccacgttcttgatatttctgtaaattattacccatagtaataaattgttgtatttttttaccatgtaaaagcctctctgaaacgccattttccgttttgtaggcaaccccatggcttaaaatacgatctaaatagccttttaagattgcaggaaatcccatccaccacaatggataaataagtgtaataagatcagattgatcgattaattcttgttcataacgaatttctgctggtgtgattttttgttgtgccgcctgtaattcttcccaagataaaattggattgaaatcaagagcatacaaatccctaactcgtgtttcaacccccagtttttgaccggtctttacagtttgctctaatattgcttggttaaaactcgtctgattattagggtgagtaaaaataattaagtgtttcatttctttctcttattttttttgaacaatcaacgtaattccattcacagcttgaacttcaataatatccccttgttgcaaccctttaccttgaatacgccaagtggtatcgccaaaaacacctcgaccaatgccattttcggctatcacttcaaccttacctcgacatcccaacatggcgtgatctcgccggtttaaagaagaatttgcctgatctttttcatctttagtatgttgatatttccaccatgcgacactcaacactattgctaagatgccataaataacgcactgtatagtcagagataaatcaataatgatggtgatcattgaaacaacaatagcggctaagccccaccataataaaaaaacgccaggaacaattatctctgcaatcaataataaaaaacctaaaatcagccaatgccaaaatgtccaagcgtcaaaccattccattttacatgtttcctctcaatagaggacgcctaagcgtccattgttactgttgtttgtcgccttttaacagttcagcaatacctgcaaccgagccgattaaatttcctgcctcaagtggcataagcacaatcttactattatttgcactaccaatttcttttaatgcctcagtgtatttctgagcgataaagtaattgattgctttggtatctccgcttgcaattgcatcggataccatttgtgttgctttcgcctctgcttcagcggctcgttcacgagcctcggcctgtaaaaacgcctcttgtcgttcaccctccgcttttaaaattcgagattgtttttcgccctcggcacgtaaaatttcagcttgacgcacaccttcagcctctaaaatatcagcacgtttattacgttcagctttcatttgtgcattcatcgctgcaatcagctcttgcggtggacgaacatcacgaatctcaatacgtgttactttaattccccaaggattcgttgcttcatctacaatagctaataaacggctgttgatattatcacgttgagaaagcatttcgtctaattccatagaacctaataccgtacgaatatttgtcatggttaaattaatgatggcttgttcgaggtgattgacttcataagctgcacaacgagcatcaataacttgcacaaaacaaaccgcatcgatagacacattagcattatctttagaaataacttcttgcgatggaatatctaagacttgctccatcatattaatacgacgaccgacacgatccacaaaaggtacgacaaaattcaatcccggtgttaaagtgcggatataacgcccgaagcgttctattgtccaatgatagccttgaggaacggtttttaaagttgaatataaaataaatacaattaataaaataaaaataatcgtagcaattggtaacccatcaaatagctccatttcatactccttgcaaaataaaacaaacacaatataaaaatactaccagcatatagtagcttattttagtttatttatctaactaaagtgcggtctgaccaagaatataagatacttattttttagttaaattcgtgacaattttagttaattatttctttatttgacttttattactacttaatccggtctgtttcattggtttgaccacacccatcactacgtttttataaaaagcggtatacggtataatagtttatccatcataaaaaggtaaataccatgtctagatatgcaaaaattttattgttaaacggccctaacttaaatatgttaggaaaacgtgagcctacacattatgggaatctatcgttagaagatattgaacaacacatgcaaaaattagcacaacaacatcaatgtgaactaatctgttttcaagctaatagtgaggaaaaattaatagataaaattcaccaaagctttcacctaatcgattttattattatcaatcctgcggcttatactcataccagtgttgcattacgtgatgctttgctatcagtatctattccatttgtagaagttcacttatccaatatccatagacgagaaccttttcgtcaccactcttatcttagtgatattgccgaaggtgttatttgcggattaggtgctcaaggttatgaatttgcattacaatatgcctcgaactatctaaagaaaataaaataatttgcataaattttaccgaatttcacagaaatttatcgcaaaaatttattttttcaggtaatctctcgggcgaaataattcattttaaattaaccgcacttttttatcctcaattttgtctaaattggggattttaatggcgatttatttatgaacagtattaattttagttattttaggaaatcattatggacgttcgtaaaattaaaaaacttatcgaattagttgaagaatcaggcattatggagcttgaaatttctgaaggagaagagaccattcgcattaatcgtggcacccctgtttccaatcctattcaatataatgttcctgttacagcacctacaccagtagttgctccgcctacagtttcggaagcaaccggtacgccagtaacacaagtaaatgaagagccgtcaggtcatattattcgctcaccaatggtcggtactttctatcgtagcccaagcccagaagccaaagcttttattgaaataggacaacatgtcaaagttggcgatacactttgtattgtcgaggctatgaaaatgatgaataaaattgaagctgataaagcgggaatcatcaaagcaattttagtcaatgatggcgaacctgttgaatttgatgaatctctgattgtaatcgaataattattttacttttataggatttttaccgtcctacaacattattccaagagatagattcttatgttagaaaaagttgttattgccaatcgtggtgaaattgcattacgtattctgcgtgcttgtaaagagcttggtataaaaactgttgcagtacattcaacagccgatcgtgagttaaaacatgttttattggctgatgaaactgtttgtattggtcccgcaccttccgccaaaagctatttgaatattcctgctattattgcggctgctgaagttactggtacagatgcgattcaccccggctatggtttcttatccgaaaatgcggactttgctgaacaagttgaacgctcaggttttatttttatcggtccaacagcggatgttattcgtttaatgggtgataaagtttctgcaattaatgccatgaaaaaagccggtgttccttgtgtacctggatcagacggtcctttaggtgccgatattaataaaaataaagaaatcgccaagcgtatcggctatccaattattattaaagcctccggtggaggtggtggtcgtggaatgcgtgttgtacgtgatgaaaaatcattggaagaatctatcgctatgactaaagctgaagcgaaagcggcttttaataatgatatggtttacatggaaaaatatctagaaaatccacgtcatattgaaatccaagttttagcggatacacatggaaatgccatttacttagctgaacgtgattgctcgatgcaacgtcgccaccaaaaagttgttgaagaagctccggcaccgggtatttcagaagaaacaagacgtgatattggtactcgttgtgctaatgcctgtcttgaaattggctatcgtggtgccggtacatttgagttcttatacgaaaatggtgaattttacttcatcgaaatgaatactcgcattcaagtagaacatcctgtaaccgagatgattaccggtgttgacctagttaaagagcaacttcgaatcgcagcaggatttccgctttcaattaaacaagaagacataaaagttaaaggtcatgccatcgaatgccgtattaatgcagaagatcctaagacctttttaccatcccccggtaaagtaacacacttacattctccaggtggtttcggtattcgttgggattctcatgtttatggtggatatacagtgccaccacattatgattcgatgattgctaaattaattacttatggtgatactcgtgaagtagcgattcgtcgtatgcaaaatgcattatccgaaactattatcaatggtataaaaaccaatatacctttgcataatttaattctttccgatgaaaatttccaaaaaggtggaacaaacattcactatcttgagaaaaaattgggtatgagagattaatatcactctcattgagttataaaaataaaagcaaaagtggataatagtatccgcttttttatggataaaaaatgaaagtacattacaaacaatcagctaaagaatctcgctatgccttgttcttaacagtgctatatcttatcggctggtgcatttttgcctatttacctgatgaggcaagaggtccacttggttttcctctttggtttgaattgtcttgcatatactttcccatagtgtttattatcatcgtgtatttgtgtattaagttcttttttaagaatctatcattaggagaggaaaaatgaacattaatatcattttacctttggttctctacttgctctttgtattcggcattgcttactattcctatcgtcaaagaagtcaaggcaatttcttaagcgaatattatattggtaaccgctctatgtcaggctttgtattagcgatgacgacagccgccacttatgttggagcaggatcttttataggcggaccgggtgccgcatataaattcggtttaggttgggtattgttagccatgatccaagttccagtagtcttgtttactttaggggtactgggtaaaaaattagccatgctggcacgaaaaaatcaaagtttaactgttaatgatattttattctctcgttataaaaatccctatattatcctactggcaagcctttcattgctgttttcgttctttataatgatgtccgtgcaatttatcggcataggtcgtttattagaaactacattacatatcgactaccacatttcagtactcatttttgctaccactgttggtatttacacttttataggaggctttagagcggtagtactgaccgatactatccaaggcctcatcatggttttgggaacctttttattactgggcggtgtcatttatgcaggaggagggattagccaacttattgatcacttagctaaaattgatccgcacttaatcacgccttatggcactgatgacagaccgcttgattttacatttatggcttcgttttgggtattagtctgctttgggttactgggtttacctcatacagttgtgcgtgctattgcctataagaatagtaaggcactacatagcggtattattatcggtacaatcgtcatcgctgtactaatgcttggaatacatttagccggtgctttagggcgtgctgtaattccaaccttagatgtaagtgataaaattattcctactttgatgatacaagtattaccacctgtagttgctggtatttttcttgccgcaccaatggcggcaattatgtcatctgttgactctacattaatccagatgtcctctactctgattaaagatctatatttacgtttttaccccgctcaaatacacaatgaaaccagaataaaacgcctatcaatattaacaactttatttctaaccttactcgttaccatagcaaccttaaatccgcctgatatgttgatctggttaaatttatttgctttaggtggactggaaaccacatttctatgggttatattatttggcctatattggaaaaaagctaacgcttatggtgctattagttcaatgttagtcgggctaataagttacatattacttaccgctcttgacataaaattatttaatttccacgctattattcccgctttattatttggcttaattgcattcttattgggaaatcaagtaggaaataaattgattaaaaatgaggaaaaataaatggcttgggtacaacttcgtttaaacagtacaaatgaaaaagcagaaaaaatcagtgaatatttagaagaaatcggtgcagtatctgtcacttttatggatagtcaggatacgccgatttttgaaccgctaccgggggaaacccgtctgtggggaaatactgatgtgattgccttgtttgatgcaaaaaccaatatgcaacaaattgtccgcctattgcaacaaaaaaatcatcttgatgaaaatactgcttataaaatcgaacaaattgaagataaagattgggaaagagaatggatggataatttccatccaatgaaatttggaaaacgcctatggatttgtcctagctggcgtgaaatacctgacgaaaatgcgataaatgtcatgcttgatcccggtttggcttttggtacaggcacacatccgacgaccgcactttgtttagaatggttagacagcttagatttaacaggaaaaactgtgattgatttcggttgtggttcaggtattttagccattgctgccttgaaattaggcgcaaaaagtgcggtcggaattgacattgatccacaagctattctcgccagttataacaatgctaaacaaaatggtgtagcagagcgtttacaattatttttatcagaagaaaaaccaaccgatttacaagcagatgtggtgattgccaatattcttgccggtccgttgaaagagctttacccgataatcagcaatttagtcaaaccacaaggtgatttgggcttatccggtattctatctacacaagcagactccgtttgtgaagcatatcaagggaaatttactcttgatccgataactgaacgagaggaatggtgccgaattaccggaaaattaaacccatttgtctaattcatttatatgattttatacaaaaaataaaagtaaattatataaaatttaaccaatatcaaaaaaatgtaatttgtataaaaaatattctttgcaaatgacttaaaagtgcgtatcataacgcaccttgtcgccttgactagcgaaagcaataaatctgatatagcataatttggagaagcagaagtgcaaattggttcttatcaattaaaaagtaatgtacttttagctcctatggcaggcataacagatcagccttttagaaggctttgttctttttatggagcaggtttgacttgctctgaaatgatgtcagccaatccacaagtttggcatacagaaaaatcaagattgcgtcttgcccatcatcaagatgcgggaattaacgctgtgcaaattgctggttccgatccagttgagatggctcaagccgcacaagtgaatgtagaatatggtgcacagattattgacattaatatggggtgcccagctaaaaaagtgaaccgtaaattagcaggatctgctcttttacaatatcctgacttagttaaaaaaattctatattcggtagtcagagcggtaaatgtaccggtaacattgaagattagaacaggctggaatcaagagcatcgtaattgtatcgacattgcaaaaattgctgaacaagcaggaattcaagcattaagcatacatggacgtacacgtgaatgtttatttaatggaaatgctgaatatgacagcattaaaaaagttaaagaacaaatttcgattcctgttattgctaatggtgatataacaaccgcaaaacaagcacaagaagttctcagttatacgggaacagatggaataatgattggacgtggggcattaggtaaaccttggctatttcagtcaatagtaagcttaatcgaaacaggtatcactattccggagccaagtttagatgaaaagtgcagcgtgattttgcaacatattcgtgatctgcatcagttttatggtgaagataaaggatatcgcatagctcgtaagcacgtatcttggtatttagagggaattcaacctaattccgattttagacagacttttaatgcaattacgaatgctaaagcacaactaattgcactagaagatttttttaattttattttattggataaagaaacatgttagaacaacgtaatccggctgaagcattaactgtttcagtattaaattcacaatctcaagtaacaaataaaccacttcgtgattcagttaaacaagcattaagaaactatttatcacaattagacggtcaagatgtgaacgatctttatgaattagttttagcggaggttgaacaccctatgttagatatgatcatgcaatatacacgtggtaaccaaacacgtgcggcaacaatgctgggcatcaaccgtggcactttacgcaaaaaattaaaaaaatatggtatgggttaatctcccttgctgaaaaaatgaggtcgctaatttggcgaccttttttaattactctatttcaatttttttaataaattctgaattcaaatctaacaaaggcaaatctgaaccttgccaagaacgtaaaatttgataatccattaaacttaatgtatccaaccccggcgtaacatttggcgtatattgttttgcgatacgtgctaattgggttaaacccaaactactttcaatagacgaactaatcactgcttttatacctaactgatgagcttgctcaatcaacttagcacaatcttgcaacgaaccagtcaaagtgggcttaatcacaattgcggctaagtgcggttctttttctaattgaaatcctttttcccgaatactttcgtcccaagccaacgctatacctgtatcctgtgcaaattgacgactatcttcctgcgttttacaaggctcctctaaaaactgaatacgcttgcgatgttcaggctttacatatttagcaaacaactgggctttcgccaatgtccagttacgattagcatcaaggcgtaaataaagatcgggaatagcctctaacaacatatcggcaatcataccatcacgatttgcttcatacatgccgaccttaattttcgcaaccttttccccttgcatttgatttaatgcatcataaagctcatcaggatcgccataacataatggtgcaacttgatagcttccctcttgctccaattctcctttcatttcagccaaagcacaacttaaaccaaaagcaacggaaggatataacccttttaatgaaaggctacaattttcagagcttgctttatcccaatcttttagccattgaatagcttgatctttcgcctgttccagtgtttcttggctaaattcaggcaagggagcaatttcaccccacccctcgaacgaaccgcagtttatttgcacaagcaacccttcacgcttcttcaaaaagcgattacgcaaaataagctggctatccacaggaatagcatattggtataaatgaaaaattcgatttgtcattactgttcacattgttgtgtattgtcattataacgaccaccataatctaaacagtgatcttttgcatcaaaaataacgaaagcggcaaaaatacctagcaccactaaaatcagtaaaagaaacaaccattttttcaacattattttttcctcaaacaagataaaagtgcggtcaaattttccactattcttaccgcactttcactgattaaatttatggatttcgcttaaatttactgaagtcaggtgcacgtttttcattaaacgcattgcgtccttcctgcccttcttccgtcatataaaataacatagttgcattacctgccagctcctgtaaacctgcttgaccatcacagtccgcattcaaagctgctttcaaacaacgcaaggcaattgggctgttgcgtaacatttcacgacaccaacgcaccgtttctttttctaaatcagcgtaaggtacaactgtattgaccaatcccatttccaatgcttcttgggcattatattgacgacataaaaaccaaatttcacgtgcttttttctgtccaacgatacgagccatatagcttgccccccaaccaccatcgaatgatccgactttgggacctgtttgcccaaaaatcgcattttccgctgcaatagttaagtcgcataacatgtgtaaaacatgtccacctccaatcgcataaccggctaccattgccaccacaggttttggacaactgcgaatatcacgttggaaatccaacacatttaaatgatgcacaccgctttcatctttatagccaccgtaatcaccccgcactttttggtctcctccggaacagaaagctttttccccttgaccggtaagtataattacaccaattttttcatcaaaacgtgcatcagaaaatgcttggatcatctctttaactgttttaggacgaaatgcgttacgcacttctggacgattaatagtaatttttgcgataccgtcagtagatttatgatacaaaatatctgtataacctgaactgaaatcctgccattcaacaggcacataaagcacatcatcatttggattttgcattatttattccttttttattaagtcaatttgtggttggtattatagcttaaataccaataaaaagtgcggtcgtttttgtggaatttttacttagaacagcccattactccgtagcatattgaataaccttcgtgtatgctcatactgagttaattaatctatctgaacaaaaaaatcgcatgaataattagtcatctaaaaccgaatacaccatcttatttattctgcataattaaaaaaacgccacagttctatctgtggcgtttccaaatttgagcaaaataaattatgcttgacctttaaccgcttttaagcctaaaaacggtgctttctcacctaatgcttcttcaatgcgaattaattggttatattttgcaatacggtcagaacggctcatagaaccggttttaatttgaccagctgctgtaccgactgccaaatctgcaattgttgcatcttcagtttcaccggaacgatgtgaaataactgcagtataacctgcatctttagccattttaatggcggctaacgtttcagttaatgaaccgatttggttaaatttgatcaagattgagtttgcaatccctttttcgataccttcttttaagatcttcgtattggttacaaatagatcgtctcccactaattgaactttatcgcctaatactttggtttgatatgcaaaaccgtcccaatcagattcatcttgaccatcttcaatagacacgattggatattctttgcataacccttctaagtagtgagtaaattcttgagaagtgaaagatttaccttcgcctttcatttcatacataccgttttctttgttatagaattcggaagaagcacagtccattgccaatgttacgtctttacctaatacataacctgctttttctaccgcttctttaatgcaagcaagtgcggcggcgttagactcaagattaggtgcgaaaccgccctcatcacctactgcggtgcttaatccttttccttttaacactttcgcaagattatggaacacttcagccccaatacgtaaagcttcttttaatgttttcgcaccgaccggttgaatcataaattcttgaatatccacattgttgtcagcatgttcaccaccgttgatgatattcatcatcggcaacggcatagaatatacacccggtgtaccgttcaactctgcaatccaagcataaagaggcatacctttagaggcagctgccgctttagcatttgctaaagaaaccgctaaaatagcatttgctccaaattttgatttattttccgtaccgtccaattcaatcatgatttggtcgatttcagcttggttgcttgcctcttttccaactagtgcggtagcaatttcgttatttactgctgaaacagcttttaatacacctttacctaagaaacgagctttgtccccatcacgcaattctaatgcttcacgtgagcctgttgacgctcctgatggcgccgctgccaatccaacgaaaccaccctcaagatgaacttcagcttcaacagttggattgccacgagagtcgatgatttcacgaccaattactttaacgatttttgccattttgttttccttctatagttaatctaaaataagtataaaaactggcgatatagtaaagctatttcgtatgtttgtcttgtaaaaaagcactttttttgattttaatccatataaattgaaagaaaaaatactcttacatatttatttttgtaattttataaaattacaattatttatattgccagtatggagaatatttattaaaattctgctatgtcatttaaataaggtatagttttatgttgttaagtaatattgtggagatcagtagcggacaggcacagtttcgtctttccgaagtcagtgatccaattgcacctgtttatacttattatggtcaggcaaacttagaacaagatctctatttatctgatggttcagcagtacttcctaaagaaataaaaacttttgataaaataaccagtttactttccactggtgatgtgatttttagtctgatttcaggtaaggcaacgattgtcagcaaacaacaccaaggttttttatatactcaaaattacgttaagttaatacctaaaaatcagatagatgccaattatttagtctatttattaaacgaaaatgcggtggttaaaaagcagttaagtcgtggtttgcaaggatctcaagtattgaaatatacgactaatcagttgaaatcattgagattacccaaattaccccacttatcggaacaacgtttaatgggagagatttacctaaaacaacaaaaattagcttatctcaaacaacgcatagcgaatttagaaaaattacttgtgttacaccaattgcaaaagcgagtacagcatgactaagaaaatacccgaattaaaatttgaaaaaaccttaattgaatatctttgtacaggaacgattacagcaacggataatatgatcggcgaaccgcctgcggattatgtagtgcgtaccaaattgtggcaatatgagccaagcattaaaacgacggaagatttatgggaaaattttaaaagaattttagaaaagctcaatcaaaaaaccttagatcgtcctttaagtgcggtggaatttgcacaagttaaacgtactatttctaatttatccacgccttatgccgcagggcagtttctttatggcacaaacggtgtgtcacaaattgaaattgatttagatgatgatcgtcatgtgtttttaaccgtatttgaccaaaaacaaatcggagcgggcgatacggtgtaccaaattgtgaatcaaattaaacgaccggcgattattgcaggaaaagaaaatcgacaatttgatactacgttgttgattaatggcttgcccattattcaaattgaagaaaagaaagaaacgcatgatattaacgaagccttaaatcaaatgcaccaatatatcgcggaaaatcaatacagcgatattttttctacgttacaacttctgattgcgattacgccaaacaatgtgaaatatatggcgaataccacagcagatcgctttaataaagattttgccttcaactggcaacgtcaatcggacaataaaccggtttatcactggaaagcctttgccgattccatgttgagtattcccatggcacatcaaatggcgactaactatatgattttagatggtacgccgaataagcaaaccctaaaagtaatgcgaccttatcaagtttatgctacgcgttgtgtgatggataaactcaaacgggcggatttcgatcaagcgttgaataaactcggttatatttggcataccacaggttcaggcaaaactattacgagctttaaaaccgcttggctggcaagtcgttcgccgaaagtggataaagtggtttttttagtggatcgtattgcactgactaaccaaactaccgaaaactatcgagcttatgatcctgatgccacggaagatagcctaggtagtgtactggataccaacaacaccacagatttgaaccgcaaattacacagcaaaggcagccaaattattattacctctgtgcaaaaactggataccttggttaaacgcacttctttcaaagctcccgaaaaaaacattgtgtttattgtggacgaagctcatcgttctacaggcagtgataattttgctgcgattcaaaaaaaatttaaacattctgcgtggattggttacaccggcacgccaatgtttgatgacactaccaaaggcttacgaactgaagatattttcggtgaactcttgcacgcctataccattcgagaagcaattgctgatcgtaatgtgttgggttttaaagtggattttgaaaccacgattagcgaaaaaagtatgaaagaagcgcatctaccgaaattctatcgccttaaatatcctcattggacggaagaacaaattgccttgaagattgccaatctcacgcaacaagatatggacgacagcatcgaaccgagtttttatgacgaaaatgaagaacacgtcagattagtggtggaagatattttcaaacattggaaaaatcgctccaattgggataacaaacgtaatcgtggacgatataacgccttgctgaccacgcacgtgggtggcggcaaagccagtacaccaatggcaatgatgtatttccgtgaattccaacgtatcaataaagtgcggtcagaaaagggggagtttttgctaaaagttgctgtgacctttagccaaaataccagcaataacgacaccatgcttgaaaccaaccaaggattattcgaggcaattcaacattacaacagcgaatttggcactaacttcactatgtctgatgtatcggcttatactcaagatgtcaccagccgtttaaatcgcaccgctgtggacaaacaatatttagacctcgtgattgtcgtagatcagttactaacaggatttgacgcccctgaattaaatacgctttatgttgaccgcactttaaaaggtgcaggactcattcaagcctattctagaaccaatcgtgtagcggatatgcgtgaaaaaccttgggggcgaattatcaattaccgctggcctgcccataatgaaaagttaatgaatgaggcgttgtccgtttacgccaacaaagattccgccaaattatccgatgaagagcgaaaagtgaataataccaaggataagattactgcaccaaaatacgaagaattgctcgatgacaccaaacagattgtggaaaatctgcgagaaataacggataactttagccaattgccaccgtctgaagcgaaaaaatgggaaatgttggaacaattacgcacctataccgccaatattgccaaaatcaagcaatattctgcggaagatgaaaatggtgaaattatcggttttgattatgaaaatccggataaattgattcaagaactcggcatgaccagtgaagaagaaagtatgctcaccaacacattgtccaacgaactcaaactgcatttagcaaaaagccgaaatgtgccagtgatacaaattgagctacaaatgacccacattaaagacgtggaaattaattacgattacttaactgaattaatttccagcttgttggcacaagtagaggcaggtgaaacggaaaaagccaaagaaacggaaaaagaattggaaaaatttgccaacggcttggaagatcgcagttttgcacaacgcattaaccgtgcggcaaaagcgattatgaaaggtgtgttcaaattaaaagatgggtttaaaaaagacggtatttctattgtggaacaagcgaataacgccaaccaagatcaacaatttttggattttcgtctccaatggggattaacggaggtgattaccaacgcccaacttcgacagcttttttccaaacatcaatttcaacaaaaagatttagatgacaataatcagcttacggatttaatcaaacaagcaggtctcacttatctcgaacttgcacaaaatgatgaagtaaaaaaactgacaaaaatgaaataccgtaaccagttgcgtcatgctatttacgaacttgcagatgagtttgtgggggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcacatcttatattttttgcaaaggatagaaaaacaaaatgaataacgaaaagaaacttgtaccgaaattacgattccccgaatttactcacgcttgggaacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaaagaacaacaaaaaatcggtacattttttaccgcacttgatcgctacatcaccattcatcagcgtaagttggaaaatatacaaaaattgaaaaaatcattgttgcaaaaaatgtttccgaaaaatgatcaagaatttccggagattcgttttcccgaatttacttacgcttgggaacagaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtgcatttttcaccgcacttgatcgctacatcaccattcatcagcgtaagttggaaaatatacaaaaattgaaaaaatcgttgttgcaacagatgtttgtttaataaggggcaaagatgagctattccattgaatatacacaagaaattgatcggttaagcaaagaaaatgcctatcgactttatgattcaggcgatattcatcgcttagaagtcgggacgacgaaaggcttgcaagatattcatcgttatttatttcaagggctttatgattttgcaggcgaaattcgtgaattaaatatttctaaaggacattttcgttttgctaacgcactttatttaaaaccggcgttaagtgcggtggaaaaaatgcctgaatcaacctttgagcaaattattgaaaaatatattgaaatgaatattatccatccctttttagaaggaaatggtcgttctacacgtatttggttggatttgatttttaagaaaaacctaaaaaaagtggtgaattggcagaaagtggataaaaagttgtatttacaagcgatggagcgtagccccgtgaacgatttggaaattcgctttttattacaaaatgcgttaacggatcgcattgacgatcgtgagattttcttgaaagggattgaacaatcttattattacgaacaagccgaataaactgatttaaagtgcggtcataaatacagaattttttaataaaggaattaaatatgagcaatgtacaaacaattaccggtaaactttgggcaatggcaaatgagctgcgtggcacgatggacgcttcagaatataaaaactatattcttgcctttatgttttatcgttatttatccaaacaccaagaactatatttggtcgataatcatattttggacatagagccttcgcaaagtgtgaatgacgcttatttaacgcaagccacaggtgaggaattacaagattatttgcaagatatttcagccagtcttggttatgccattaatcccgaagatacttgggattcattaatgcggaaaatttacaatgccgaagtgatgccaagtgattatcaagccttatttgataacttcaaccaaaacgccaatttaaatgaagatgcggtgctagatttccgtggtgtgtttaatgatttgaacttaggagcttctcatttgggcaattctaccaatgagcgtgcgaaatctttaggcaatattgtgaaattggtggacgagattgaatacaaagatgatgacggtcgggatattcttggtgaaatttatgaatatttgatcgggcaatttgccgccaatgcaggcaaaaaaggcggagaattttatacaccgcaccaagtttcaaaaattttagcgaaattagtaacgctggatgtggaagataatcaagagactttccttgtttacgacccaacaatgggatcgggttcgttattattgacggtaggtaatgaattgccacaatcgaaacccattaaatattatgggcaagagctgaacaccacaacgtataacttggcacgcatgaatttgatgatgcatggcgtatcctataaaaatatgacgctatccaatgctgataccttagaaagtgactggcctgaaggacttgatgcacaagggattgatcaacccttatgtcgttttgatgctgtggtggcaaatccgccgtattccgccaagtgggacaatcacgagcgtaaattaaaagatgcccgttttcaaccttttggtgctttggcacctgcttcaaaagccgattatgcctttattttgcatagtctatatcacttaggcgagcatggcacgatggcgattgtattgccgcatggtgtacttttccgtggtgcggcagaaggtaaaatccgtaaggcattgattggcgataacaccagcaatgcacaaggaaactatttagacgcagtgattggtttgccagcgaatttattctacggcacaagtatcccaaccacgattttggtttttaaaaagaatcgtaaaaataaagatattttgtttattgatgccagccaagattttgacaagggaaaaaatcaaaaccgcttaacagacgagcatgtccaaaaaattattgacacttaccaagctcgtcaaaatgtggataaatacgcttatgtcgcttctcttgaagagatcattgagaatgactataacctcaacattcctcgctatgtggatacttttgaagcagaggaggaaatcaatattaacgaggtgttaaaacaacttcagcaagataatcaagaaattgcacaattagaaaaagaaatcaacgaacagttaaaattattgggagttgaacttccataacaaggaaagagataaaagaggcaaaagcctctttttttataaaattttgcataatgttaccgcacttttgagaaaaaaactcacgcttgggaacagaggaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaacaacaaaaaatcggtacattttttaccgcacttgatcgctacatcaccattcatcagcgtaagtaatacatacaaaggagatatattatgaacgaagtaaattcaaataaagagctgttttatcaatactattcacgctggattcatatgtacaaagagggggctattagaaaagtcactatggcaaagtatctaatgacattagagtggctaaaaaaactgattccaaatctcttgttgtgtgatcttaatcgcataagttatcaacaattactcaatgattatgcctgttatcacgaaaggcagaccacgatggattttcatcatcaactgaaaggggcaattcttgatgcggtagatgaagggttattaccaagagatcccacaagaaaagcaattatcaaaggtcgcccacctcgtttgaaaaaaacaaaatacttaaatcaatttgaactgcatacgttaattacacaattaaatttaaccaaagaaattaactgggattggtttattttattaattgctaaaacagggatgcggttttcagaggctttggcattaacaccaaaagattttgatttttcacatcaaacactgacaattaataaaacttggaattataaagatggtggtggttttcagcctacgaaaaatcgttcatcagtacgaaaaattcctttggattggcaaactattattcaatttgctgagttaattaaaaataagcctgaagaacagcctatttttgttcgtaaaaaaatttttaattccacagtgaataatatcctgattaggcgttgtaaaaaagcaaatatcccaattatttcattacatggtttgcgacatactcatgcgtcattgttgctattcgctggggtatctattgcaagtgttgcaaggcgtttaggacattcaaatatgacgaccacgcaaaaaacatatttgcacattattcaagaattggaaaatcgagatattgatattgtaatgcgttctttatcaaatttaagttaatttagagctacgtcacttacgctgatgaatggtgatgtagcgatcaagtgcggtaaaaaatgtaccgattttttgttgttcttcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacttcctctgttcccaagcgtaagtttacataaaacaaaaaggctatcaaatgattgtatgataaccttaatgagataacttaaatttttctattttatactataattattttctctgattttccttagtcgcttttacaccacgatagccacagctactaggaattaaaatacctatgcctttcgtttcgacatcttgcgaatcaatgtatttaatattgacttcacctgtcggatttgcttcttgataaaacactttttccccattcagataaatccgcttcttgacaatcaagaaaaaattgctataaagcactctatttttgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgttcactatgaatatgaacaattaagaagaactatcaccgcagcagcactatttgtgtctaatttttatttagctcatcgacaaggttattttgacttatctgccaatgaaaatcccattttacatatttggtcattagcagttgaagagcaatattatttgtttttccctcttttactggttattgcctataaaaaatttaaaactcatcaagtatttaaacctatagtattgggtttaatgttgctatttattttaacttcatttatccctcaatcaatttatatcaaaatcggttggagtaatacttattacatttctttcatacgttttccggagcttttaatcggatcttatcttgcattaagtaaaccaagagtaaagcctgttaataattttgttggtttcggtatttttattgcacttatcttaacgctattcttttaccataaatcaatgccgttaatgccaggcattgttctactcctaccttgtattttaaccgcacttcttattcatttctcctcccaaaactcatggggggggggggtaaaaactctcttatcattaaagcccatcgtatgggtaggtaagttatcttattctctctatctgtttcattggatttttattgcttttacgtattatatttcaggtgaaaagaaacttcctcaaggtgcaattttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaaagaaacctatattttcaaggttttcaaaaaggaaaatttataaacaatataccttgtagaatayctctggtatctaacaaactataaaaataaaacttttataatagctaacaatataggtataacaaaccaaattctataatataaaaaacggataaatctttttattattgrttcagtttgttcttgatatataagttcacttgcatatatatcagataaatttttatatatttcaccattatctcccatgactatactttcatcattaaatgattcagcaatttccattaagacttttaatgaaatttcatcaggattagagagccataarctattatcatcataagatataaaraattcrtactyatytttataaaaaattcttttttcataatctacggagaatcctaaactcgtcatcttktttataacccgctcaaaatcatataatatyttatcagtgctaagtttatctgacttatttacaatagatacatgatagcccatattatttttcctgcttatctgtaactgttttataaagttctatctaacaaatcgggttattaccacattcctcaagcatagctttacggttagattcgcttatgcctttatatttctcaaaaatcgctttcggctctttaccttctttctcagcttgagccagttctctaatatcacaatagtattatatttattttgccattctttatttgtttcaatttttcatttcttgctttgtatatatttattattttataaacatatgatccgatatttttttcagacatcaaaaaatctttccatataatagttttaccatcaaaaatatctatataatcccaaagggcatccaagttatttccaaaatattctcctaattctggaacttgcttggataattgcttataaaaatcatctggagaaaaaatttcctttccttcaattattatttccatcttccaacctctttaaatgttttataatgatctgtagtaataaataataaaccgtcacttgaatataataatctcgttcctagttgtttatttctacctatattgttattaataccaatatcagcctcataccaaactcttccatctttactaggtaataagttactttcgtttctaaaaatatccccaccaatttgcccttgttttaaaggtttgccacttgaccaattatataatttttagctatatccttagttacatactcatcaggtaattttccggtttttttcaaactatcaatgactagagctgtattttgttctgcttgtaaatctaattttaatttaggatacaacgctacattctcagccccgcttgatacccttagcttagcatcctgcttctcgtaaccttttggtggtgtaacaataggctgtctagtcagatatccttttatttcccttaaagataaagaaccaccacctacagccgccccagcttcaatagccatgctggcataatgaacactacttggcaaggctgcatagctgtttgcattctcatctcctacaaaggtcgccattttacctttaaggctattacttaatccatttacataagatatcactctcaacgcagaaaggtttttataaacttcatcattccctgttcccatttgataaatatggggaagataacaaatcgggttattaccacattcctcaagcatagctttacggttagattcgcttatgcttttatatttctcaaaaatcgctttcggctctttaccttctttctcagcttgagccagctctctaatcagcttttctacctcatagttattgagatagttattctccaccgcactttccccaatctctccactcaatgctgcattttgtacggtgttcaccgtgctatttgattgattgttttatcgggattgtaagaaaaaatatccaaatctatattttcatctgtaaatatcttagagattatatatttaaatctctcatatctgtcatagatgtcagaattatctttagttaaaagggtaaaactatcccaatttggaattatcaataattcaattattcgcataatcccaattaaaatatcttgttttatcaattttgtgtttttataggttattgctatatttatcaaatctttttctagtttccaatactcatcatcattccattctgagtaatccaaccatcttcctatgaatgaattttcatcatataaccttgaataggttacatttctataaaaatctgcgtattctgccatatttaatctccaattttatttaagttaatatcaaaagttccgtttcttgtttcttttttatttaatttttcaggactagctgcttctttccaagctcctccattatgaccatccacatctctagttatatagctattaccttttttaaacacaactgcaccagacttatcatcaaattttgttcactgactttttaaagtttgacgttttccttggttgtcaattgttttcaactctaatcccatcagctaattctaggtctaattccatatctatgatcaaatttataataattttttttgcatcattcgtaattgaaatttctctctcatataactgagtacagatcaactcaagagctataccatactcatcataattaattaaatccattgcattctcacaatcctcttcaggcaaatttttataaagcaaagatagtagatttttcattttttctttcattatattactcctgtttaatagggaatgcggtaattacaccatttcccattggttctacaataaccctaattctaacgccatcaacaactccctcaactttaaatctactcggaacaccctttttagtatacaaacttccttttgttcctgtttgttgtagccattctaaattaggatcagtagcaatattagatataacgtcgagaatttttttctcagaccagtgtattgggaatttagattttccattcagaatatttgtaaaagaaaatttatgcccaccacctgttttatctccatataatatatgttcagctctctgagaactgactagagataccatattttctctagcagttattagattagagacatttttagtaacaactttttgaaatacatttatagcttcacccgtcaataaaatactcggtgcttccaacgatttacccagactaagcatatagccttgcatttctgcggctaacatagagtcgttttctaaagcccaatttaactgctcattccattgttccgctgaaatcaccactttatcaaaggtctctttcgggttttggattacattcgccagtgttgcaacggttttatcaagatttactatcccatcaactgtgccttgtacaccttctacaaccgctttagcttccccaattttcattgcatcataataagcttccgctaattcctccgcattttctttatctttgaaaagcgttttggcaaacatttctatcgattgcttacgttcttctgatgggtgaatgtcatcaccaagaaaattaaactccaccgcattctcagccaccctcattcccgtactcactgtcgccaatgtaccggctgcggtatcactgcctgcagctacaccaccggccacacctgcaatccctttgataacctgaataagttcttgcttttccatttccgtcagttctgttggggatttgccatagacggtttcgcttaagattttcgcacccacttcacccacgcctgtagccactgcacctgccgtcgcactaccacctgataaccgggcttccattgctccccataaaatatgggcaggaatatttaaggcttgtaactcagggctgtctgtcactttcttaatcgcttcattcacataaggcgataccacacctgccacaattgcttctgtcggtttccctgcaacaataaggcttaatgccgcagcgactgcggttgccgcctgtttcttgttaccacccgtttgccattcttttgcagcttgttggtaagcggtagcttcttgggctttttcggttgcagtaacaaggtcgccttctttagccgctttcgctgcttcttgctctgcttgtttcgctttttcctccagttccgctgcttgccgaccggcataggtcatcaccgcacctgcaacattgcctgcctcttgtgaaaggatttgttgttctttcaacaccttattaatgtctttcggtgcttcaacctgtttattcgccttatcaagttcggtattaatccccaacgcttttgctgtggtttggattggatttgtgtctttgtttaaggtgatttccccctcgatgatagtggttttggtgattgagctgtcattactttgactatgcatcggtaagctcggggttatgttcggagcggtttttccttcaaccaacatcgcattttctgctcctttaccgtaagtgcctgagattgaaacacttgttgccttatgacttgattcattttgaatgtcattaaaagtgaggcgattggttcgcagttcactgttgtttggggtagttgaagcaatggtgctgcctttcaagtggatgttgtttgcttctatatgataaccgcctttgcctgcaattaaacctgcctgttcattaacttgtttataactgcttttacctttctcacccgaagcaaaaccgctcacactccaagcattaccaaaactcacatctacactaaccccagcctgactgcctttgctgttgtaattgttgctgtcttgcttgctttcaattcgaaggtcgcctttagcattcacatcaattcgctcagcagtagcggttgtgccgttgagggtaatgtccccttggctgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctcagcctcttcttttgtgagatcacttattcctttcatatacaaaccaacccaataatcttcctttggtatagctgtgaagccatcttctgaaaaatcatttatcacgatttttgctaatattgatttttctccccattctgtcatttgaggagaactttcaaaagaaatatcaaatataatcaatccttaatctacttaaattcattatcaaaagttacttcataattagaatgaaattgatgaattctactttcagaatctaaagcgtaatgacttttaccctattgtatagaacgtcctaatagtaaggttgaaccactattataataatattcactatcatcaattagaattgcttccatttttaaatactttctctttagatgaataatttccacttccccaaaaaaaaccatatattactatatggtagtcttttctatttgcagaataaaagcactctccaagcccatcaatatcaaaggaaaacattttacaataagattcactatttgaaataggggtaaaaacactactaatctcatctaatctagatgggatatatccattttcatatatatataactcgatcctattaactatatcatttaatcttttttccataagaaaccattcaaactttaataaaaataaaaaaacaaacaataataaaataaatttgataaacttcactatttatcctcctttgtaaaaaatggttttgttgttttattcttaattccagagtgactgccattatctatattaggtaaagtattataattaggtgcattcttaggattagtcgcacctaatttctttaaatagttagaaacttgctttcctagacttaaatttgatttaggatcgaaatatttagctccaaattcggctccataacgatctgatggtaaatcttcatatgaataggcagaatgttttgcaggaggatataaagaatctaatctttcttgccaatatccatgcttaatagcattaagcatcgctctattttctaaatttccatctgagcaataactatttaaaatacaaggaaaatgtctatttatactctctgctatctttattaaattaactttttctgaataagcatcaccggcataaaaaacaaaatgaaccatatctatccaacctgcattctttgtataaatatatctatcagatatactattaaacggtgctgtcgttgcaggtttcagattccatgtaagatcatttaatctaaagagagcatcttctgcttactcattttttaataatcccattttagtagatgtattattaaaaaattcctcgaatccttctactgtcccggcttgagccttattaaccgcattattctccaccgcactttttccaatctctcctcccaatgtcgcattttgtatggttagacagtatgtatattaatagtatttagtagtataaaaatcaatttttccctttagtaaagcttcttttcttccaatccagcacagaaagcaatattttcattatatagcctttttcatatttaaaatttaattcatctccatccttctccaaaaatatataatcgttatctttgctaaataaaaaataaacaaatatagaattatcctccatttcaggactagaaatagataataactttctctgtttagatgaaatgttatcgacaagattaatattatcagtttgagtcatggaacctaaaatatcatcagtaatatttgccaatgtaaatctaagctctgatgtatataactcattaataactgaattaccttctatatatatattgaaaataccattaatccaaaagtagtcatcattccattcagatacaatgtcgcactgtattgcaaatttataaggatctccaaaaaacataattactcctatttaaactttaaatctttgggtataggtaaaggattatcaggatctcccgaactaccagaccaatgatattccccattcgtaccaaagaatctatgaatatttccctgagagtctttcgcatatctaatagttttattagcttcaatcttatattctactgaatttttaaataaatctagtgaatctctcggttctattcctgcattttttctatttcccatcatgccttttgtatgtttaggattagatttatattttacagatattccatcttcaaaatttacattgacaggaacaggaactggtataggggaagatgtcctagtagtatttttcttcgcaaaattattctgcgtattagaattacctaaactattttcttttccaaaaagacgagaagcatttactgctaactcaatacctttttctatccctgtctgcttctcttttatcgcttgaatagtcttctggttttcactttcaaccaactgatagaacttactctgttcttcaaatggcaatccttgaatccaattattcaatgctcctgataaatcatcggcaaaaccaaccgctcccaataattcattcggtactgttgctctgcaatcaatctcacaattagccactaattcagcacgttgtttttcacttaactctttaaatctctgatgaacttcctcaacactctcaccattttgaatcgccgcttttaatgctttttgatattgataaacatctttaatagaaagggcgttaaactccaccgcactttttccaatctctccacctaatgctgcattttgtacggtatttaccgtgttgttcgattgattgtctgtctgcgaaataacaccgcctgcaaccgctcctgcgattgaagctaaagcgataatatgttgccgttcttctgccgtcagttggctagcttcggttttattgtatagtaatttcgccaaggttggtgcagcaagttctgctgttgccgccgaaaccgcacctgccgtagcattgccttttaacgctgtcgcttcaatggctccccataaagcgtgggctaacgtgttgctcagaacatcaacattaccttgttcatccatcgttgcctgtttaattaactcattcactttcgggcttaaactttgtgtcgctatcgcccctgcactttgatttgctaatatcccggttactatagtggtcaatacgttggctgttcggttatatgtgccattgttatcccattgtttttgggcttgtgtcgcttcaataagtgcggtcagttttgcttcaatttctgatgaacttacattcggattcccttgcacttgttctaaggctttttctgcctcttttactttctgctctgcttccgcccgtttgtttgccgtgtaagtttgcactgccgaactaatatgccccaccgcctgaacaatctccttttgctccgccagtagttttttcacctcttttggttttgccacttggctgtttgcttggctaaggtcggtattaatccccaacgcttttgctgtggttttgattgggtttgtgtctttgtttaaggtgatttycccytcsrtrakmgtsgytttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcattttgaatgtcattaaaagtgaggcgattggttcgcagttcactgttgtttggggtagttgaagcaatggtactgcctttcaagtggacgttgtttgcytctatatgataaccgcctttgcctgcaattaaacctgcctgttcattaacttgtttataactgcttttgcctttctcacctgaagcaaaaccgctcacactccaagcattaccaaaactcacatctacactaaycccwgcctgactrcctttgctgttgtaattgttgmtgtcttgcttgctttcaatycgaaggtcgcctttagcattcacatcaattcgctcagcagtagcggttgtgccgttgagggtaatgtccccttggctgttaaacttaatatgttctgcatctaaatgactgttatggtaagtggaactttcatacctacttccacaccaacgttctgtcctcagatttccatttactcccctttggatttattttttatccttactctttcctcccatatgtctagaggaacgaaatattcattctccgcctcttcttttgtgagatcacttattcctttcaaatataacattggccaactgtctgcttcttctatatatgcaaatttaacatcgaatgtaccatcattatttaaaacaaatctactttgagtccaatcactaccattcaccttcatttccgattttaaattttcataaagctctaatatatttcttttttcatgaggaatacaacctacagaataattgcattcatccccggcattatttatccaatacattctaaagcttgatatcgtttcatgaaattcacattcaaatatatacttatcagcttctgttggcattagcttccatatttcattagctattttaaaaaataaattgttacactttttgcaattcatactattctccagttggagtgttttttatcttaggaagttcaatgacttttccatttatagagtagttaatatcaaaagaatcaggtcttttactattccctctatatattggtttaatatcaacctccactttcttaccttgctctaaagcttgcttccattgcctttccatctgataccattttcctttcggtccattcaatatctcatccattgctacaagatttattttctctcctgcacctctaaacattgatgccagtaaatgtcctccgcaatcgctttctaaacgacattcccctccggttatggcttgtttagatttattctttatttttaaaaagtttattatttataaaagtttttaaaattagtgccaaatacaaccaaaaagacccccaaaatatatcactaaatgcatcattagcccaataaaaatcatcatatttaagataaatataaatcatgaaaaacacatgttttaacgaacaaaaagagacgataaaaaaataccaaattagccaataaaaaaaactattttttttcattaggtatctcctttttcaaaattagaaacatcatctaagacgtcttctatagttcccttaagaacatctttatgtttcataattttgattttttcaattaactctccttgattaatattacgaaaaactctagctatatgagctatagataacaatgataccttttcaagttcaacatctccggatgataaaaaagaaaataatatttcttttgttttagaaggttcatcagtatacatacctaacgacaagattactttatgtttaatattattctcaacttcagaagaatttaatattaccattccatctttaaaattaatcttgtctaaagattcatatattaatttactcattttattttcctttatcatgagtataatcaaaaatatttatatgcattcctatttctggatcataatctaatcgctaacttttttcatttgatgatatgcgaccaataacctttccatacccatcactgatttctaaatttcatattatcttccttcacttaaagatgtttcacagcatcatgaatatttttaggtaataattgcatattattagggctactttgagcattatgatgccatgtataacattattaggataatatttgatagcaagccacttgatactcaacattactagtcttatatttttcgataagatttctacctcccaaattcagaacttgagcttcatttaacacatatgaacaacaagcaaattcatcatcatcatcaggattaatatacaaaatcgttatattttcaggtaattgaatgaatagagaatccaacagttcatccgtatcattactatatacctctatatatctctctaatttcgtcatggttctatccttctagtaggatctgcactcttagtttgctttcctgttttataattaaattcaccaaggtgttttcctttatgattatatttctctaatgtgccatgctgagaatcccattcataaatatatccttctctatctttccatctatttcgtagttttcctccaccttgtatcgaagttttacgctttacctcagttaaacctgtaattcctgtaatttcatcttttctaggtgcagggatatatttccaatcattaggattttttgcttttttagcaaaatttgcttgtgaactagactgatttaaagcctcttctttagcaagcaaatgagctacaccaagggctaattcagcccctttttctaaagcactttgttgagctttcaagacttcaatagttttcgtattttcttcttcaactaattgatagaatttactctgttcttcaaaaggcaatccttgaatccagctattcaatgctcccgataattcatctgcaagaccaacagctttcaataattcatttggtactgttactctacattcaatctcacaattagcgaacaattccgctcgttgtttttcacttaactccctgaatttcttatgaacttcatcaacactttcaccattttgaatagctgcttttaatgctttttgatattgataaacatctttaagagaaagggcgttaaactccactgcactttccccaatctctccacccaatgctgcattttgcaatgtatttgctgtagtgttcgattgtttgtttgcctgtgaagtaacaccacctgcaaccgcccctgcaattgaacttaaagtgataatatgttgccgttcttctgctgtcaattggctcacttcggttttgttgtacagcaatttagccaaccttggagctgccagctctgctgttgctgctgaaactgcacctgctgcggcattgccatctgcaactgttgcttcaattgctccccaagtggcgtgagccaagatattaagtggcagattaacatcaccattttcatcggttgttgcctgttttatcaggttattaaccgttggaccgacaagttttgtccctatcgcccccgcactttgattcgctaatacaccggttaaaacagtggtcaataccttggctgttctgttgtatgtgccattgttatcccattgcttttgtgcttgtgttgcttcaataagtgcggtcagttttgcttcgatttctgatgagcttgcattcggattcgcttgcacttgttctaaggctttttctgccaagtaagaataggctttatttaatattaaatttatttgatattattttttttatacataatcctataaataaaggaattgcaaaagataaaatatcacttaaagcatcttcagcccaataaaaatcaccaaatttccaatagatatatataaatatccctatatgctttaatgccgcagcagaaaatactgccaaaaataatgcaattaaataaattatcgtcttgatcattttgacaactccttgttattaaggtatttctttactttttcataatcttttactctattatcaaaatctcctccatactctccaaaagcaccgccaagaatatttccaaaggtagaatctttaaggctaaatggcttatttattataggagaaactattgcactgaaataatcgctgcctaaggtatttccactaggatcttttgataagctggttactgttgcaatacctatattaatcctaatttgattayccaatgatcgatttctggttaaagcacctmctgaaaatgcacctaacgcatcataaggattaatatcttgccctgtaactgttttatatcctacatgagctccaagcgaaatacctccatcaatcaacattccagtggtgttaggatatttagtcgaaaattctcctattacacttgcagttgtttttgccgcagatgaagctcctttagctattttaccaacgtattggacaccttttacagccgcactatgtgctcctgttcccacaaatgaaagccctgttgcaagagagttgctcaaacgtccttcaaaactttccgaatagctatatactctttgagctcttaattttaaatcagaataatccggttttatttgtggtgaatctattggtgtattcaataatctcatttgagctggtacatcgctatattcctttacccacttaaacaggatttctctatctttttgagtaagggtatcaggactggtttggtaggtatgtaataacttgtctgaaacctgatctttctttaataaatattggattagtattgcttcttcaggagttaatatttttttctctactaatctatttaatttagcatattcatgctgtgataagaaattatttttcaccgcactttttgctgtctctgctcctaatatcgttgatgaagtattgccacccgttacattgccgacaatcaaaccacttagctgtgaagccactttgaggagtgtccgttcttcattgtttaattgctctgccgatttattgaaaaccrcatccgaraggaacattgccgtagyctcacctgccacaccggyagtcgctccgacaagggcatttgtacctgatagatgtgcttcagtagyagaaagtaaagcgtgagctaacaaattagccattttactgtcttttgtcattgtgtgaatttgtgcattcagctcmggrgaaatcgcarcarcgacaacttgcccagcastgccaccacttaaaattgcccctaccgtagcaacgacagcatcaagtttacgtctttttgaaccgccctcttgccattccacatmttgtgtttcttttgccttgttattggcataaayattkrctgcykractaatatrysmcactgccygagcaatctccttttgctccrcmagyagttttttcacctctttyggttttgccacttggctgtttgcttggctaaggtcggtrytaatasccaacgcttttgctgtggtttkgattggrtttgtgtctttgtttaargtgattttcccttccgtaagcgtcgctttggtraykgarctgtcaytrcyttgactatgcatcggtaagctcggggttatgttcggagcggttttgccgtaagtgcctgagattgaaacacttgttgccttatgacttgattcatttygaatgtcattaaaagtgaggcgattggttygcagttcactgttgtttggggtagttgaagcaatggtrcygcctttcaagtggatgttgtttgcttctatatgataaccgcytttgcctgcaawtaaacctgcctgttcattaacttgtttataactgcttttacctttctcacccgaagcaaaaccgctcacactccaagcattaccaaaactcacatctacactaaccccagcctgactgcctnnnnnnnnnnnnnnnnnnctgtcttgcaatctttcgccgttttctccccgtcaggtaaagtccgtctgtgtcgcctgaatatcaccgcttcttgccctaatctcaatctgtttggcgttgacggtgttgctacttgtatctaatacaagcggtaaatttaccgatagagtttgcaaaagtttaatcaaaacaaacactttgctgaatatatcctataaaccaaaatttgaaatcaaatcagaatcaaatattaatttttttgtatcgtatatgtatattaaattaggagggtagcgatccccaataattaacatataacgatcttctatataatcatattcatgtataaatgctaagctatcatctatatctaaaggaaaaacatacatttcttttgctgttggttttaaacctgataaacaacaatgtaagctctctggtaatttgccgttttctttctcatatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattttttgacctatagcttgatagattttttgaatttccattatttactctcttgttggtgtatttctataaatttcatttattttatttcctccattgactttataggaaatttagcataaatctcttctttcctattcactctgtccctccaaatttctaaaggaatataatattccttagtttcttcttcagttagatcacttattcctttcatatatagcatattccaactatcttcctttggtatataagcaaattgaatattgaattctcctgactcagtaagtgtaaattgacaatgagaccaaaaatttccatctaatttcattaagttatttaaatctctaaataaaaaaattaattttgtagcgatttcatctggaaaatcattcatactatattctttttttatagactttgatgtaatccaaaaaagcttacaactttctgtattaggaaatatctcacactgaacaacatattctttggcttcaatagacattattgaccaaataaccttagctatttcaatatattttctctcatataaagcaacattcattaaactattctcccgtagcagtattttttaaatttcttctatttatactattatcaatagagaacttaatttcaaaactatcaggtcttttactattccctctatatattggtttaatatcaatctccactttcttaccttgctctaaagcttgcttccattgcctttccatctgataccattttcctttcggtccattcaatatctcatccattgctacaagatttattttctctcctgcacctccaaacattgatgccagtaaatgtcctccgcaatcgctttctaaacgacattcccctccggttatggcttgttgatatctatttctgtcatttacctctaattttaaacgaccttttacctcttctacccttcctaatgcgtccgttttatactcatgcccattactcagcttataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataccccactgcccgagcaatctccttttgctccgcaagcagttttttcacctcttttggttttgccacttggctgtttgcttggctaaggtcggtattaatccccaacgcttttgctgtggttttgattgggtttgtgtctttgtttaaggtgattttcccttccgtaagcgtcgctttggtgattgagctgtcattactttgactatgcatcggtaagctcggggttatgttcggagcggtttttccttcaaccaacatcgcattttctgctccttttttgctcagtttgccggtttcactatcttggtagtaatctgctcctttaccgtaagtgcctgagattgaaacacttgttgccttatgacttgattcattttgaatgtcattaaaagtgaggcgattggttcgcagttcactgttgtttggggtagttgaagcaatggtacygcctttcaagtggacgttgtttgcttctatatgataaccgcctttgcctgcaattaaacctgcctgttcattaacttgtttataactgcttttacctttctcacccgaagcaaaaccgctcacactccaagcattaccaaaactcacatctacactaaccccagcctgactgcctttgctgttgtaattgttgctgtcttgcttgctttcaattcgaaggtcgcctttagcattcacatcaattcgctcagcagtagcggttgtgctgttgagggtaatatccccttggctgttaaacttaatatgttctgcatctaaatgactgttatggtaagtggaactttctccgttggctttttgactaccgccaccgacagtagcataaacccctacaccagtttgtgctcctgcttgagcaaacatacctacttccacacccacattttgcccacgggatttttccttggttcgactttcgcctgcttctatttctatcttgtttgcatttagctcaatccgactgttttcaaggcggttgccgtctttgtcttttgacacaatatcagcatgctcaaggcggatattacctgtaccgctttggttgtgatttgccctcgattcagttgataaagtgcggtcggttttgttactgttttgtgcgttgctttctgtgttatcacctcgagctgttagcaccacttcttttccatttaacacattcccttgactaagatgagcttcactttcctgtaattggcgactgtgagcgacacctgtgccactttctactcgtatcaaataaccggtattcggcgttttattggcaattttataaatgctgtcggctaatgtataaccctgagccgccaaacctaaggcttgtgcagtctgaagccttgtagaggcctctttgttttttaccacccgttcaactgtttggataatatcaataatcggcgatttgatgcgactaaattgtccgattttcaaatcactttgactttgttgttgtgtttgctcattatgagctgccactgcttcaatattctctgcggtaatatgcagtttgtttttcgacagtatttgacttgaggtttgatgataatccttgcctgcattgatttccacattaccattaagactgacaacttgactgccttgatgacggagactatcaccagcttgattaaaccgctcacgatgataaccaaagaaacgctctgtttctgatgtcgccacctcaccaatggcgtgatgttttctcgcttggcgttgagtttgtgtggtagtcgccgtcgtaaaaagaatatcacctgtcgcactgaagctgttattgccttcacttaccaacactaaacctttacctatgatgtcgccctgttgagcagtggtttggctgtttccgcccacggaaatcaccgtgcctttttcctcaatcaacgattgcttgccgttttcacgccctttgccaacacctgctatatatttatttaacccgttaacctcaaatcccttattggaactgttcgccgattggctataacggttgatggctacatcaaaatgaacatcgccggcagccgtaaaggtcgcatctttttccacagataaagttgcaccttgggtgatgatatcgccaccggtagcgactaccgttaaattgccttgcgtgtctatgtttgcactttgagcaatcacctgttcagtttgtttgttggattgatgactttggtgcttgatgtaaggctgaatacctcgcattatcataccggtagtatccgtaatagcctctgctcgtgaaagctcatcaccaacaaatccatttgcaacaccttgctcttgacgttgtttgtatttttcttttcctacttcaatcgggttgtacaccatattcacaccaaccccaccggatttgctgacatagcgactttgcccaaggtgatgctcatccaccgcattgatatttaccttactaccttgaagatgcgtatcgctaccactatggatttcagtagcattcaaggttaattgatgttgagccgttactcggatattgccttttgcattcagttgtgttgcaaccagctcctcattgtgacttcgattatttgattcagttttattgcgttgatagcccaccgacacaacaccattcgaaagactaccactcaaaccgctttttttggctttctccctatagtccgtcatttttgtattgatgagtacattcaaatcaatgtcttttgcagtaatatcaatatgttgtttcgcatttatatcggtagcttcggtttttaatttatcacctgccacaagtacaatactgtcaccttttaacaagctaccctgatagttatcttgctgttcgttatagtgcgtttctttacttttcttagaaatagcattaccgcttttatagcgatgctgttcctcaagtgttgatactgtttttattgccccaaataccatctcatttgttgcaagtgcggtcagttttttcgctgtttcaatcgccgtactttgcgtgtaaagattattggtttctaggcggatattgctgttgctttgtatccggctaataatgaggttttgattggtttcttgacggcggtggtcgcctgtccctagtttttcactgtgttgggtagaaagtgcggtgctttttaggctgtttttaatattaagcaggctgtcacctgtgccactgttaataatatcactgccgatttggttaagattgtcggcgttgatatataatgtgccgtcttcgcctttcacgtggagtaatgccttacggtcaaggtgcatgtttttataatggtacccataacttggattgctactttcatcggttttcgtggttgagcggtgtgaaaatgtgccacttacattcaaggctaatctgctttgtgcttcaatgtgtccgccttcattagttaaatcccctgatgtctgaacataaagtcgttgggcggataaggtaccttgattatgcaagctatcgccatttaactgcatcacttcccgtccgaaaatcctgccttggttaatcagttcgctgttttttgcataaatgttattcgctgaaatcaggctgccttttgtggttaatggtgaaaaatctgctttgttcgctacaagatagactttcggtaccaatacttcttgttgacttccattaggtagtgtcactgtttcagtttccagccacacaatatcggaagtcaaccttgccctttgtgctttactcagtttcacgccaggtcgtagggtaaattcattcgctagagtttggctgaatttaactgccgaatccattaaggcttgatattgcacttcaaaatcttgctgatgccctgaagggagtttaccggttaattgataaagttgttctcgcacaaggcgttgttcatagtagccgtcgcctaaacgtttttgtacttgatttgagtcataacgaagagcattaaacatataatcactacttaaccatttacggtaatcggtaaaggctggggtggtttccactaaaatatgactgtccgcttgcggattgatttgataaagagaagaactcggtagtattgttgtcccttgtgtaaaacgaatttcacccttgccgtctgttattttaataaatggagctgtagtttgagaattgctttgtactgtcgtagcaacggcataatccccttgagtttgactaaataccacatttaatggaatagtcacattatccacggtatggcggtcatgtcgtcctccccatttgcgttggaaatagcgtttgaaccctcctcgccattttgaccaagtaaattcgtgattaccgaattcttccgtagaatgaatgccttcttcatcagtgtttttaaacggactattttcatcttgacttactaaatttccaccggacagtattagcgaacggtcattatgcaccgcaccttgaaaccacatatcgccaccagccaatattttacccggtgcggtttgtttcaccaccgtttggctgattttgcgacggttgaggttaatgtcccaaaagcgatcatagattttgttggaaaaggcggcgttgtgcttttcaattgccttttctaattgctcaaattgtgtctcattggctttcaaccaatctaaataaggtttcagttgcaatgaaagtgcggtctgttttgcctgatattctaacttgtttacctcataatccgctttttcggtttcatagctttgtagacgtttagcaaaatccgcttctgactcattattttctcgagttggtttttcgggttcattgggaatgtcaaaataggcttgtaacagatttacatcaggataatctttgagggtcaaatgtactttttcatctaaatgaatattaaaatgtgaccaagccccgtcattaggtagatacaaagaatgtggtttaatttgacaatttttcttaccggtaagattgctgcaactttcttcattcggcatcggtaagacataaccgttaaagttgccattggattctctctcttttaactcagttgctcgagatgctactttaccggctcgactaaaagatatccaacgcaaggtgttaaaatcaattttggcagaattaggttgtccttcgggtaataaataatgttcatttaattgggtatcactttgtaattcaaacgctgtttttaaatgttcgttactattgattaaggatttcactccaaaataagcattgccagccacatcaatcaacccactttgatttttaaaattatcggcaaaagatgagttttcagaagataactcgacttcctcagttgaattcaaacggcgaccgacaaacaaatccccctgactcaacagacttggaccttccgtgatttgaccgttttgcttttctgctatggtcaaaaattgtttttggtttatcagttcaggtgctgccaaatccaatcgtttatgagcggcaatgacggcggatttaacatcgttattattgcttgatagttgctcgtctcgattgacaatacgagcaccggcttcaatggcgactttatcgcctaatatttgtcccgtgccaatattttccaccgtctctgttgctttgataactgtcttttccgttcctaataccgcgcctcggttaatcagagatttttcactttcaatccgattttgtcttcctcgaatcacaccgctcgaagtctgttcgatattctcttttgcttttacctcaaccctatcttctgcgtacagcttgcctgcattatctaaagtgcggtcggttttaagacggttttttgtcgctgctattatttgaccggatgcggtattcacaatcttgccctggctatcaatcactacctctgagctacttgcaccaatatgtcctgcattgcgtaccccaacgccgttttctgtaccgataagataaattttgcccgaatacattccgccaagctctgctacatcaagggaaaattgcggttgtgactcgcctgaaacgtgttgggttgtgtgaataatttgcaaagttttgtcggaatcaaaccgcttgatactatttttccctgtgataacggttgcttcttttttcgaccaaatccctgcattcacttccgcttctcgagcgaggatttcagtataatccacacgactgttgtccaagcctttgccgctgacattgattttaccggcttcaaccttaaaactctccacttccccgtttttaatctcaggcttgcctgtagaaagtgtcactcgaccggaatttatcacaccgcaaccttcacaatgtagcccggaggggttggctataatcacatccgctttgccgcctgctacttccacatagcctttcatcacggacggcgaagaagaattgatctcgtttaaaatcactttcgcctcacctcgggcgagataaggattagccgtcacctgccctgcaagttgggtagaagtgcttgtgcgactgttatttaaaattactcctttctcggcaacatcaaattgtgaatatttattatgggaaagccctttggtattgggcgtttgaatattgacttgcggaagcccattggtagtttgtaaaacaatgggttgttgggtttttggggcggatttatccgcttgaataattaaagtttcagcaaaagcagaagagaaaaacgaagaaaaagaaaccaactccaaggcacaaaacaaactgaaacaaagagcttttaacagagctaaaagcgaagaaaaatcgaccgcactttttgaacaaacagaagacgaacatgaagatttgtcttgggattttgcaagttctgatacaacgattaaacgttgtaaggggttactaaaaataatgcaaaaatgttgtgtgttcataataaatcctcctgatttttccgttttgattatcccaacctgccattcggcgtttttgtacttcaatttccgacttatcaatatagttttgcgattgatgtgaccaaagtgcggtggaaattgtggtttttctgtgactgtcacgataaatcaaataaaacaaaacaatgtaagcttatcggtttcactttcacctgaataaatatagctgttatcaaatgcccattgatggataggatagcaaggcaattcagtataagaaagcaaaagtgattcagtaggagagatatttaggcgaatatcgggtttaggctgtaatttatcatcttttgcctgctgatgttgttgggctatatcgtttaattgagtattaaatgtattagtgaaagtggtagtggatattacggaagaaattaagcttaaaatgagtgtttgatggcatttcataatatcaaatagaaaattatatagtcattctaagtagaatatagaatttatcattttttgcaaataatgttactcagtatttaggaaaagaagagtatggttgatattttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactccgttttatcttttaaatggatggattttataccgaacacttcattccttttggagttttatgtcaatggggattggaatacatctgtcatctctgaatcaacttagcaaaatgcgatcccgccatgtattaagtaaaactattaaattacttggtttgtatgtgaaattacattacatagttttattagttggtgctgatcgctatagtttgcattatatttcaatgagattaagcagttgttgcaggttccattgagaataaacgtaatttattcattatataattcaataagataccgtaagccggcacaaaaaatagaatactaatgaaaattttaaataaataatctacagaaccgatttcgacccagtgttcagccataaacggatcgttacttgcgtagaaagcaataccaaagaatatgaacgtatccgccagtgagccgaataccatagagcaacttggtgcaatccaccaagtttttaatttacgtaaatggttaaatacatacacatctaatagttgcccaaacaggtaagccgcaaaactggcaaacgcaatacggaagacaaatgtgttaaatgatgtaagtacatgtaaaccttgatattggctatcggaaaataatgttgaaacaagatagctgatgattagtgcggggatcataacgacaaaaataatccatcttgcttctctagcaccaaaaactcgcacggttaaatctgtggctaagaaaataaaaggaaaggtgaaagctccccatgtattgtgaaacgaaaaattctccgcaaatcctaaagttgtgagaggaatggtaatttcaaaaggaatttgaacgaggtagttgcttgccgtaatgataaatatatggaagaaactcaagatgattaatgcacgttttttttgttgatcattgaagatcgaagagatgtttttcattttgtgtacctttttgataaataaaattggggttagggaacccaatataaacatgtccaaaattggagacggagaatgatactgaattaagaaaatatttcaactaatatttacaagccaaattgctatttttttgctattctacacgacaatttttatattacatttaatggatcacagtcatgagcgaaccagaaaatcttgcacaaaatcaaccgcacttttcagaagatacaacgcattttggatttcaaactgttgcaaaatcagagaaacaaaaattagttgccaatgtttttcattccgtagcggcaaaatatgatttgatgaatgatttactttctttcggcattcatcgagtttggaaacgctttactattgattgtagcggagtgagaaaggggcataaagtcctcgatcttgctggtggtacaggggatttttccgcaaagttttctcgtatcgtaggtgaaacgggaaaagtgattttggcggatattaattcttcaatgttggacgttggacgtgaaaaattaagaaatcttggtatcgtgggtaatgttgattatgtgcaagccaatgcggaagaattaccttttgcagataatacgtttgactgtgtgataatcagtttcgggttgcgtaatgtaacagataaagacaaagcattacgttcaatgtttcgggtattaaaaccgggtggacggttgttagtgttagagttttctaaacctattttggatcctttaagtaagatctatcatttttattcttttaatgtactgccaaaaattggtgaaattgttgtgaatgatagtgacagctatcgttatctggcagaatctatccgtatgcacccgaaacaggacatattaaaagagatgatgataaatgccggttttgaacaagtcggttattataatttaaccgccggtattgtggctttacaccgaggctataaattttaggatagagtatgttgcctgattttaattctttgaaaacacagtttatgttaccgcagtttattaatgcgggatgtgaactgttattaaattatcttttgcgacggacaagtcatcgtgaaagatacttgcgtcaattacaaggtaagatcttaaagctgacattacaaaaaacacatttttctttgtatttcgttttttcagcacagcaagtggatttattgaaccattatgaaggtgatgcggattgtacagtggatattgcggtaaatttattattgcaaatgccgaaaaaatcggaaataagtcgatttattaatgataattcgcttcaatttagcggggatttgcagatattacaagattttgtggagttaatggaaatgttggaaaaagatccggcagagctgatttctccttacgttggtgatgtgattgcacatagtgcggtcagttttcttaaaaatttaacagaatcgataaagtatcggcttacgcaaggtcagcaattttgggcggagcgtttgacagaagagtggacagtactttcgcccaaattggctgtaatggatttttgcgatcaagtggaaagtttagcaaaacagaccgcacttttagaacaaaaaattaatcagattttagcatgatgaaacttaatgatattaaacgtttatataaaatagtacgtgtttttttatcttatggcattgatgaaattttaccgcataataaatatactcgttcaattcgttgttggcgaatgttatttttttggttaaaaaataaacataaaaataaagcgtttggattacgtttgcgtttggctttacaagagttaggaccggtttggataaagttggggcaaatgttatcgacacgtcgtgatttatttcctgcggaaattgctgatgaattggctttattacaagataacgttgagtctttttcaggaaagattgctcgtcagcaaatagaacaagctttgggttcttctctagaaaattggtttacagattttgatgaaaatgcacttgcttccgcatctattgcacaagttcatactgcaaaacttaaattgggcgaggaacaggaaaaagaagtggtcatcaaggtgttgcgtccaaatattcagccacaaattgaggcagatttaagttggatgtataaattagccagtttattgcccaaattatttcgtgaggggtatcgtttaagagcggtcgaagttattcaagaatatgaaaaaactttgcgtgatgagcttgatttacgtgtcgaaatggcgaatgcaataaagttgcgagaaaattttcttgatagtccgatgttatatattccaaaaatgtatgaagcattttgtcataaaaatgtgattgtgatggagcgtatttacggcattcctgtttccgatgttgagacattacaacgaaacggcactgatatgaagctattggcggaaagaggtgtacaagtcttttttacgcaagtatttcgtgatagtttttttcatgcagatatgcacccaggcaatatttttgtgaatccgcttcgtcctgataatccgcaatatattggtattgactgtggcattgtggggaaattaaatgagagtgataaacgctatttagccgaaagttttgtggcattttttaatcgtgattatcgtcgggttgcacaaatgcacgtagatgccggctggaccccacaagatacgaatattgatgatttcgaacaagcatttcgagaggtatgtgaaccgattttcgccaagcctttatctgaaatttcatttgcacaagttttactgaatttatttaatgtagcacgtgaatttaatatgcaagttcaaccacagttagtgttattgcaaaaaacgttactttatattgaaggattagggcgtcaactttatcctcaattagatttatgggatacagcaaaaccctttttgcaaaattggttgaacgagcaaataggtatgaaggcaacatttaaaaaattgaaagccaaattaccttatttgcaggagcatctacctgattttcctgaaactttaatggacgccttgaaacaacaaaaatttattagtcagcaattagtggaaattaacaagaagttagctaaacaacaacgttggcaaaagaaaatgtttgtattaattgtgggaatagtgattttttctgtaacgttatggcaattcgctgcattgccgttggcgataagtgcggggttattcttagttggttttttagtttggctaatcggttttttgttaccttaatgcgttagatcaaaaataatccagtttagctattgtcactatgatttaaaatggttatattctgcaagattttttattaagtttaatgtcataggagaaataaaatgggatcaagttggcaacaattactaattttgcttttagttgttgtggttattttcggtactaaaaaattaagaaatattggttcagatcttggcggtgcggtaaaagacttcaagaaagcaatgaaggatgatcaacctaaagatgccgaatttaaaaaaatttccgaagaggtagagcaaacttcagtcgaaaattcaaaacaaaaagagcaggcataatctgtgtttgatattggtttctccgaacttgttttactttttgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaggtgcaagaactgaaaagtgcggtgcaaaattcacagggtactgcaacgactgaaatagaaaaaaatcttgattttccttccggtgagttatctcctgctgaacttgcagagttagcggaagagggagaacctatgttggaacttactgaatctgatttttcagaaaaggagccaacgactatctcgtctaatgaagtgattgaaaatagtaaagaaaaagtatgagtgtcgaaaagtctcagccattaattaaccatttattagaactgcgtgatagattattacgcagtatcatttttgtagtcgtaatatttctcgccttagtttatttcgcaaatgatatttataattttgttgcctcgcctttattagatgtattgcctgccggtgcgacaatgattgcgacgaatattgcgacacctttctttactccgattaagttaaccgcagtagttgctttatttatttcagtgccttttctgttatatcaagtttgggcatttgttgctcctgccttgtatcaacatgaaaagcggttggtatatcctttgctgttttccagcacattgttgttctatctcggtgtcgcttttgcttattatgtggtatttccattggtatttgcttttttgactaagaccgcaccggaaggagttgctatcgctactgatattagcagttatttggattttgttttagccttatttttagcctttggtatatgttttgaagttcctgtggcaatcgttttattatgttggagcggtgtaaccacgccggctgatttaagaaaaaaaagaccttatattattgttgcagccttttttattggtatgctattaactcctcctgatgcgatttctcaaacattgttggctttgccgatgtgtttattatttgagataggtgttatttgtgcgggtttttatcagccaaaagatgaacaggaaaaatcataaaaatgatttgaatttgagtgaataagatcaaattattctctctggtttgtagaaaggattggaaaatgactaaacaaatatttaccggatatcctcaacgccgtttacgtcgtatgcgtaagcaggattttagtcgtcgtttgatgtcggaaaataagctgacagtagatgacttgatttatcctgtgtttattattgagggagaaaatcatcgtgagtcggtgccttctatgcccaatgtggagaggttaacgctcgatcaacttttacttgaagcggaattgatggtgaaatacggtgtgcctgttattgcattgtttcccgtcattgaacaagagaaaaaatccttaatggcggaagaggcttataatcaagacggtttagttcaacgagcggtaaaagcattaaaagcaaatttccctgaattaggtgtactgactgatgtggctttagatccttatactgttcatggacaagatgggattattgatgaatatggatatgtactcaatgatgtaacttctgatgtacttataaaacaagccctttctcatgctcaagcaggggcggatattgttgcccctagcgatatgatggacggtagaattggtagaattcgtaccgcacttgaaaagcaaggctttgttaatacacttattatggcttattctgctaagtatgcctcaaattattacggaccatttcgtgatgctgtcggatctgcatcaaacttaaaagggggcgacaaaaaaacctatcaactggatcctgctaattctaatgagggattacaagaggttgctcttgatattgaagaaggtgcggatatggttatggttaaaccgggtatgccttatttggatatggtttatcgagttaaagatcaattcggcgtgccgacttttgcttatcaagtatctggcgaatacgctatgcacatggcagctattcaaaatggttggctaaaagaaaaagaatgtattatggagagtttactttgctttaaacgagcaggtgcggacggaattctaacttattttgctaaacaggtagcggaatggttgtatttagacgaaaagaataaataatttaaaatagattttactttaacccacttcgtgttagcgaagtgggttttgtttatctacaattgtatgtctaatttatcataggctcgagaaactttttctaacgccttatcaacagaaatatcacgtgcaagaataacacctaaacgacgatgcccattgacttcgcctttgccgaataagcgaatattagtattaggttcttgtaatacttcgaataaattaccaaattgtacttggttagatttgccttcaacgacaatcgcttttgaggcggctgggctaattaaattaatttcaggaattggtaatcctaatatggctcttgcatgaagtgcaaattcagaaagctcttgcgagatcaacgtaaccattcctgtatcatgagggcgaggagatacttcattgaaaatcacatcatctccgcatacaaacatttctacgccaaaaatgccacgaccgccgagttccgtcgtaattttttcagcaatatgttgagcatttgcgagagcttgtgcagacattgcttgcggttgccaagattcacgataatcccctttttcttgacgatgtccgataggtgctagaaatgaagttcctccgacgtggcgtacagttaataaagtaatttcatagtcaaatttaacgaaaccttcgacaattacacgccccgctcccgctcttcctccttgttgtgcatagtcccatgctttttgtaggtcgtctttgctttttaagatactctgaccatgtccagaagaagacataatcggtttgatcacacaaggaatgccaaggttttcgaccgcactttgaaagtcatcaaaattatctacaaattgataatttgatgttggcaactttaatttttctgctgcaaggcgacgaataccttcacggttcatcgttaattgtgtagctttagcagttgggacaacattaaagccggcttgctccaattcaactagtgttgaggttgcgattgcttcgacttccggaacgatataatctggtttttctttttcaattaatgctttcaaagcatctccatctaacattgaaatcgtgtaagagcggtgtgcaacttgttgtgcaggtgcattttcatagcgatctaccgcaatcacttctacaccaagacgttgtaattctataacgacttctttgcccagttcacctgaaccgagaagcatgacttttgttgctttaggggttaaagctgttcctaatgttgtcattttttgtccttttacattgtgttttttattaaaataagatttaagaattgagtaaagtatcatctaaaagcagatcgtcatttttattaatgcttatgcctcgattaagaatattccgtgcaatattatgtgcatcttccaatgaatgttcagtataggttccacattgatattcgtttagttcaggaatttcggcttgatttttgacgtttaaaatatcttgcattgaagctgaccaagcgtttgcaacttgttgttcatttggtgtgccaattaatgacatataaaatccggttcggcatcccataggcgaaatatcaataatttcaatttgttcactatttaagtgatcacgcataaatcctgcgaataagtgttctaaagtgtgaatgcctttaggagagaggatttctttattaggaatacaaaaacgaagatcaaaaacagtgatattgtcgccttttggtgttcgcattgtttttgcaacacgcacagcaggagcattcattcttgtgtgatcaactttaaaactgtcaagtagtggcataatttttcctttagagataattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaaattttctttattttattgagttctatacttttcattaccctatcaaattaattcgtcttttttatataaaaatggggtagaatagccgacagaataatccaacataacttcgcaggagaataatcatggtaactcgtaaagaattggcaaatgcaatccgttttttaagcatggatgcagtacaaaaagcaaaatctgggcatccgggagctccgatgggaatggcagatattgcggaagtattatggcgtgattttttaaaccataatccaactaatcctcaatgggcaaatcgtgatcgttttgtgttatctaacggtcatggctcaatgttaatttatagtttacttcatctcaccggttacgatctttctatcgaagatttaaaacaattccgtcaattacattccaaaacaccaggacaccctgaatatggttatgcaccaggtgttgaaactacaacgggaccgttaggtcaagggatcaccaatgcagtcggtatggcgattgcagaaaaaacgttagccgcacaatttaaccgagaaggtcatgaaattgtcgatcatcacacttatgtttttttaggtgatggctgtttaatggaaggtatttctcatgaggcttgttcattagccggtacgttaggtttgggtaaattgattgcgttctatgatgacaataatatctcaattgacggtcatgttgacggttggtttactgatgatacacaaaaacgctttgaggcttacggctggcatgttattcctgctgttaatggtcataatgcggaacaaattgttggtgcaataaaacaagctcaggctgagaaaaataaaccaactttaattatgtgtaagactatcattggttatggttctccaaataagcaaaatactcatgatagccatggtgcacctttgggcgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcggttgaatttaaacgccgtttaaatggggaattaccggcaaactgggcaacagaaagccaagcctttattgaaaaattacaagcaaatccagccagcattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatgtagacggtaattatattaattatggcgtgcgtgaattcggaatgtctgccatcatgaatggtattgcattgcacggcggatttattccttatggtgcaacgttcttaatgtttatggaatatgcacataatgcagtgcgtatggcagccttgatgaaacagcgttcattatttgtttatacacatgactctatcggtttaggagaagacggcccgacgcatcaacctgttgagcaaacaaccgcacttcgcttaattccaaatttagaaacatggcgtccttgtgaccaagtggaatctgcaatcgcatggaaagcggcggttgaacgtcaagatggtccaagtgcattaattttcactcgacaaaatcttgctcaaatgaaccgcacttctgaacaattggaaaacgtgaaacgtggcggttatatcttgcgtgcatgctgtgaaaagggtgattgtccggatttaatcttgatcgccactggttccgaagtggaattagcgatgaaagcagcggaagtgttagatgcggaaggcgtgaaagttcgtgtagtatcaatgccgagtacgaatgtatttgataaacaagatgttgcgtatcgtgaggcagtgttaccaagtgcggtaactaaacgagttgcaattgaagcgggtatttcagatttctggtacaaatatgttggtaccaacggacgtatcgttggtatgaatagcttcggtgaatcagcaccggcagatcaactgtttaaactctttggcttcactgttgaaaatattgtggcaaaggcaaaagagattttataatcagttaaagtttaattttgtgagcgggtaaatttacccgctctttttcagtattatgtagcagttgtacaaagcttaatttagtgtttctgctacattttttcttactctcattacaatttaaaggtaagaaaaaatgaatgccttagaaaagttattatgcgatgacgcttcaagcactgaatttacaaattaaatcaccattttcggcaagttcgctacaatccgattggtttccaaacttacggtaaccacccgtaaaaatagttccatcgggtaacgtgggttttgcatggtttcgatagcccaatcattcgcatcatttacaatgccacttgctttatcgactttcaccgattgacgttcaatcacccattccaatgcaggtttgccgttaaccgcatagccgtaagcctcttcggggatattttccagcgtaaattttttgttataaatcactttagttggatcatcttcatttttgcctgtttcaagattcaagcgttttgggtgtttcattttttccacataaaaatcgctatcagcaccgccaacaatcctatcatttgaaatagataaaccgcctgtaaacaatacgccgttatacatcggcacggtttcaaaatttaaatgatagtgagctaattcacgcccagcattagaaaatgcccaaaaatcgaccgcactttttactctaggaatgcgtggcaattgcttactgagattatccgcatatttttcccgataatcttcgctatgtaataacccatagatatagtagaaaatatcttctttttggatattttcttgctcgccgtaaaattcggtgaagtgttttaaggcttcatcggtgatcgccgagcgtctttggtaagtttttggcggaatttgaccgcgtgtattttgttctgtcattgtttggttatcctgttttattcgtaaatccacatcggaaaacattgtccgttcgcttgtaattgaacatcgggtatctgatcggtaataatcaccgaaaagcccttgctcgttcccagtcctgttatgcaaatcgccaaattctctactcgtagatccacatcgggaagcattgtgcatcgccgatgagatgcagatcggggatctcgttgctgatgagaattgagaatcccttgttgcctgtaactgtgaggcagatgataatgttgtctgtctgtctgtctgtctgtctgtctgtctgtattttctacgctatcaaacaaatcttttgggaaaccttgaccgcccgaatgttgcatattgagatctgggattacatccgtcattacagcagaaaattcttttcctgaatttcctgaaccgcttaaatagatcatttgatttataacattgggagcgggaaataatttgggtaactgatatggacgatggttaaatgttttatcaaaataaatatgatttttagtataaggtctatacaatccttgtcttattttatctttagagaatctttctttttctcctttacttagcttaggataaagactgctagaccaacttattttagaatcatctttatcagcaaactgtacaggatcaatttctaaatttgtttttctttgaatatttaatctatctatttcattattaaaaaatgtaatagaattattcatattttcagataatctttctttagaaaaattgtaaacccaagcatcacgatttgtctgtaatccagctgaataattttcaaatatagtaggttctttattatttttatcttttgagcctaggaccatataactatcaaaattcggatctcgttgatttagccagtcattaaactgatcgggaataatttcctgccattgttctgtttttgtaattccgttaattgaaccaaattcagcgattttttctaatttttcttttcttgatagaaaatcaccaatatcataaaaatgaatattgccatttttttctttatctggatttttaactaaaatagaaatagcaactcctgtcataatatcaaaaacattttgaccttcttttttagccgaaataccagatttaccacgaatggcacctcttaaatggaaaatataaagatcgctaaattcatcgtgtaaacatttacgtaatccatttgctgcattcgtttctaaaaaaccggcattggtaatgaaaccaattactcctttatcttgaatacgatcacttgcccaacgtatcgctttaatatagctatcataaagtgcatttttatttgttgcagttgaatgtaaagcataggtatttctaattttttcttctaataatggataacttgtgttttcattattatcatttgctgatgtttgcccaactgaatacggcggattgccaataatcacttgaatatccaattccttttgacgtttacggcgttcgctgttttctaccaaaatttgatcgatgagatcttctttttcgtacatttggaaagtatcagttaaacagataccattgaaaggttggtaagcggttggattttcgttattttttgcaagtagcgagtgataaacactttcaatgttaattgccgcaatgtaataagcgagtaagacaatttcattggcgtgaatttcattatatttttgtggtaatttttcaggcggaataatcccgctttgcaataatcgggtaatgaatgttcctgttcccgtaaatgggtctaaaatttgtacacctttatcggcaaggctagcgttaaattcattttgtagcacatcttccaccgagtggataataaaatctaccacttgaattggggtgtacacaatacctaatttatcttttaatttcttaaatgcttgagcaaagaaattatcatataaatctttgatgatagattgtcgtccttctggacttttgatattgctaatgcgttgctgaatactctcgtagaactcttgtaactgtttggtttctgcattggcgatattttcgccttgtaaaatagtaatagtttcacttaatgctttagacattgggttgtgttcggtgaaattatcgttagcaaataaggcatcaaaaactggtttggtaattaaatgctgagctaacatttcaatcacttcatcatcactaatcgcattatttaaatcatcacgcaattctgccgcaaaggcgttgaaagcggtgatttggtgtttattgttagggttttccaaaatcgctttaatccggtctatatgagtttgagcaatttttgccacatctgccgcccattcttcccagtgcatacgatttccacattttttcacgattttggtaactaatgcacgctcaatttcgccaatttcaaactcaaattcttcttgaattgggaaattagctcccgtgccttttgcaccgatattgtgctgatctcgccccgatttttcatattttttctttttcttgttttgatcttttggctgctttttcaaaatttgcgagatggtagaaatgacttcgattttatctttggctgcaccatcaaactgcattttgttgatcattgcatcaaaacggtcatcgtgagaacgcagagcattaagcacttgccatactactttatagttttcattattatctaaggcttcttctggcgttttcccagcaggaatcactacaggcaaaatgacataacctcgctttttgccttctgctttccgcattactcgccctaccgattgcactacgtcaatttgtgagtttcttgcagttaagaataacacggcatcaagggctggtacgtccacaccttcggataaacagcggacatttgagagaatgcggcaggtgttatattccgtttccgatttcaaccagccgattttgcctgttttttcactagcattcattgagccgtctacgtgttccgcttcacattttagttgtagcgattggttgagatcataaggtaagccctgttcttccaatgatgcaatttcttgttcttgataggcttcaactaccgtcgagaacatctctgcaatcgctttggaactcactttgtgtttattacctctgtaatttttctcaatcacttggcaaaatgctaccgcacgtttcatgggttgataatcatcggcaagatcttcttccacaccatattttgataatgctttccaacagccaacgatttttgccgcatcgtccacttggatttcattaccttctgcattcaaaagattctgcaaacggcggttaatatgcgcctcttcaacggcaagtaccaacactttataatcgactaataagccttttttcactgcggtagaaaagctgattgtaaatagttcttcgccaaaaagtgttttatcgtccattgaataaacttccaccccttcagattttttggcatcttcggtatagatgcgtggggtggcagtcatataaagacgtttttttgcttggatataatcattattgtgaatgcgaacaaatgccgattctcgctcatcgtcaaaggtatgtcctgtagtgcggtgggcttcatcacaaatgataagatcaaaactatttaagcctaatttttgagcctgatggataacatcaattgagtggtaggtagaaaagatcacggtcattgcttcattggcatttttgcattttataccccgaattaaaccgcttgcatcggttgtggcagggtaggaaagctcgtgtaatttagtttgaactaaatcatcgttagattgtttgccgacatcactatcggaacagaccgcaaagctgtgcagttttacaccgctttcttgtgtccattcagttaaagtttgagaaagtagtgcaagacttggtacgagaaacagtacgcttttcccttgtccagccattgcttcggcaattttgagtgaagaaaaggttttaccagtaccgcaagccataattagcttaccacgatcggcagtttctaaacctcttttaactgcttttagtgcttgaatttggtgttctcttaattcctttttagcacgcaatacaaccggttgttttggcacatatttttgccaatcgatcacactttcttcaaaattggaacggttgataatattgactggaataagttgatcagcaagggatttttctgcattttcagaccaatggtttgtcgtggtaacaattaaacgatgtgtaaaatcttttttacccgatgcagtgaaaaagctatcaatatcgcttttttgaatgcggtaatcggcagaatagtttttgcattgaatagcggtaaatgtgctatcaaaaccaacagcgactaagtcgatacctgtatcatttttatttgtgccttctggttgatatttttctacccaatcagcaaaggtgagaatttcttgatagagattcgtatattgcggttcgttggtgagatagtgttgagttaaggtttcaaaataagtgcctttttcacgctgggtttgcgaattttcttgcaggcagattaaaagttgagaaaatgctgattgattgattgattgattgattgattgattgattgattgattgattgattgattgattgattgattgattgattgattgattgattgattgattgattagacatcatattttccttttatcattgtatcaacacgctgaatttgatctgataaaggatagcaggttagtttaagttgagctagtaagagcgggtaaatttacccgcttttttttgctttttggttaagtgaagaataaaaactcaaatagaataatcgctattttgtcttaatagcattgagttagatccccctttaatgtaaactattgtcccgtctttatgggaagttgtttgttgtcaaagcaaattctccaacacttattttcatatcaaaaacacataggtttaatatggctaccaattatatttttgtaaccggcggcgttgtatcttctttgggaaaaggaattgcagcggcatctttagctgcgattttagaagctcgtggcttaaatgtaactattatgaaactcgatccttatattaatgtagatccggggacaatgagtccgacacaacatggtgaagtttttgttactcaagacggtgctgaaacagatcttgatttagggcattatgagcgttttatccgcactaaaatgactaagcgtaataactttacaacaggaaaaatttattcagaagttttgcgtaaagaacgtcgtggtgattatttgggggcaactattcaagttattccgcatattactaatgaaattaaatctcgtgtcattgatggtgcggcgggatatgatgttgccattgttgaagtgggtggaaccgttggtgatattgaatcgttgccatttttagaggcattacgccagttagccgtccaagttgggcgtgaacggactatttttatgcatctaactttggtaccttatattccaactgccggagaggtaaaaaccaaaccgacacaacattccgttaaagaattactctcaattggtattcagcctgatgtattaatttgtcgttcagatcgcatgattccacctaatgagcgtgcgaaaattgctcttttctgtaatgtaccggaaagagcggttatttctttaaaagatgtatcatctatttatcaaattccggctttattaaaatcacaagggttagatgattttatttgccaacgtttccgtcttgattgtcaagaagcggatttatctgaatgggaaaaagtgctttatcaagaagcaaatccgacaggtgaagtcactattggcatggtaggtaagtacacggaattacctgatgcttataaatctgttaatgaagccttgaaacatgcgggattgaccaatcgtttaaccgttaatattaaatacattgattcgcaagatgtagaaacaaaaggcatagatattttaaaagatctggatggtattttaattcccggtggctttggctatcgtggtgtagagggcaaaatcttaacagcacaatatgctcgtgaaaacaacgtaccttatttaggaatttgtttaggtatgcaagtggcgtttattgaatatgcacgtcatgttgccggactaaaaggtgcaaattcttccgaatttgaccgcacttgtgaatatccagtcattgcgttaattactgaatggcaagatgcagaaggtaatgtggaagtgcgttctgatgaaagcgatttaggtgggacaatgcggttaggtgcacagcaatgtcatttagtcgaaggaagtttagcatatcaattatacggttcggatattattgaggagcgtcatcgtcatcgttatgaagtgaataacgttattcgtccgcaagttgagaaagcaggactgaaagtaacaggcttaagtgcggataaaaaattggtagaaattatcgaagtaccaaatcatccttggtttgttgcttgtcaatttcatccggagtttacttcaacaccacgtgatggacatccgctatttgcaggctttgtaaaagccgcaagcgaaaaccggaaaaaataaacgtgcagaaaataaaaatagcttgggaaatccaagctatttttttcttattgatatagttccgacacaagttgaggagagagcaatctttctttttcatggaacaaggttcccatgtagtaagaaccgaacggagtgaaatgatcttgatcgccataaatagatttatttcctacataaactgtatcacctaaatattttgccgcatcaacccatgtaacattcggaatgtttttaattaattggaagatttcattgttgcttgcggtattgtccgccaatttttggatcggatttaaatatttatctaagtcatattttgctaagaatgcatttctaagagcggaacgatttaacgagatattattcgcaaacacatagactttttttgtttttgccagatgtttaaccatcgcttgaaatttttgatcaaaatcagaaattacaaaggaattaggattgaatctcggtacaggtataccgcctctttttaactcataaaacatggaaataaaaatgacaggataagattcaattttttgccaatattgtgcacaatctttatcctcaaatgagaggcgatcacgaatgtttaagatatccgaacgccacccttcttttgaaccgacataatttaaaaaatcttctagatgccctgcatgcgaatcacctatggttaaaattttacttggaatattgagaggcaatacttcttgttccgctttctgagcttgtaaagcagaagttttatgctttatatgagaacgtacacttaaattgtagccgatgacaactaatgatgggattaaatataataggaaaaaagactgtttaaaggttaatttagattttctaataggttgttccaataaataataacttaatgccgaacaaataaaagtgagtacgatgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgctgatttctgtccgctttttagtataaggcttgtaatagttaaaacgccatatctttgaaccgctaatctctacagataaaaaaagcccgttgccgtctcttaatggataagctttttttttaatcttcgctttttctatttctgtatttgaaagaggtttgattaatcttgccataagtttagtagtataaaaaagaaaaaaataaagtgctttgcaccctttaaaatcaaggctctagcgatttttagtagtataattttttagataaaaatgtattttatgattttatactaccannnnnnnnnnnnnnnnnnnnnnnnnnnnnnnnnnnnnnnnnnnnnnnnnnnnnnnnnnnnnnnnnnnnnnnnnnnnnnnnnnnnnntatttacaaaggtttatttaatgaatttgaaagagtgggaaagaatggaaaatcggatttggtgccagtggtcggactcgaaccgacacgcttttaagggcggcggattttgaatcaagtgcgtagaactgttcaaataatattcgcaaatacacacttactacgatgtatccagccaatacatccactaggattttctgtccgaattccagacgatcctgatcttacacattctttcaagtttgtaaagcctgataatgattttatagtatattttttacaggttagattacaaatataatatatactagcttgactttaggagataatcattataatctgattgtcaaggtggcgttaccttaataacgcaatgagttgttggctcatcgtcaatctgatattaatctaggatgtaaaggcctagcggtggcaggcaccagaaaactctgatactaatctaggatgtaaaggcctagcggtggcagacaccagaataaaccaacatttaggcccacttaattgtgggcttaatactttatgaaagaagcaaatatgactaataaatttactggatacaaaaaactaagcattaatgacttgaaaaaatttgagtataatttagagcatataagaaatgccgcaatctttttcaaagatcattttcttagtaaagaaatgatatatagtactgaaaaagaaagtacatccgttatctttcaaagaagcaattttatgcacttgtgcggaatatattatgaacccggtgcgagtgaattttttaatcttgccttattaaaacaaatagacctaaataaggtttatataaaaaatgatggcacaacattccaaaagttgtctgttttaagttctatagattttttaattaatccagagataactttgtcatcaggtgcaatttatttaaacctttcttttgataaagctcttagaactaaaaccagagtctttgctctcacattgataaatgacaatcacttatttattccacaatctttactgaatcttaggaccatgaatgatttccctaagggtaacaaaattattggtataaaatcagttcatttagaagataaaacagaaatcatctacttatagaaaaaagaataagagaaattatattctcccatttttattttatcagagtaaattcacaatcttgggcatttgcattatcaaggcaatactcaaaggagctcaatctttgataaatcatcaacggagaagtcaattaaggcacttgcaagaacatttaaggatagtgatcatacttatgggaagctcaggaacttctcagaagctccgctgtttcttgactcaaagtcatcaagattaatttattagctgatttggtttcctatgccatatttaggcattatgaacataatgatagctcattttacgatcttataaagaataactttgatcatcataatggacgtattcacggtttatatttacgaaatacagaggatataatcccataagtatgaagtatagaagggcgatatcctctctaataataaactctctcaacatttctatgtcatactcaatatatcagagcttaatactaatatcattatgcattgacaatttctgaatgacatagatattttccggtttcttcattaattgagtaacagcggtatatcaaaatctatatagtacctaagaaaggcttacttgcttagaaatatattaaaaaatatcttttagcttattttgaagcatatcttactatcttatgaatacataggggaaaatattctaaatttattctagcgatatacagagctttatcattaatagtattaagggatttacatctaatttttagatgctctagatagtctttctaccatatgaagaattgtcgttttatcttgttctgagctatttctataatagcttaataaaatttcttcttctttagtaatgcttaatctttctctaattctcaataccccactattgagcaaaacattttttatatcagaaagtatttgatttagaaatttttcattttctttttgaatatcatctatcaattcctgtttcaatgccaaagtttccttagttactcctaaactagtttgtacagattctggcatatcatacacgtagtattcaaaaacattacctttcactccagagacacgccgtctacgccatttatcttttttagcatataagattataccttgtggtgttgaagggagccctcctacatctaaaagctctttaagagtataccattctttcatattacctcattgactttattttaaatttaagttaaatttaacttaaattgaattaactttaacttaaaagatcaaggctaattcaaggagatctagtctacattaaattgagtgctatttgaagatcgcttatctaaatgaggttttgtatgagttttgaacaattattgcatttatttttcttagaacggaatcatagacctgccactatacgttcttatcaaaatgtaatagcgcagattgttaaattttatccagataaagaacctgaacaaatatctaagcttgacttattagaatggagaaagtattgcctcaataaaatgagcccaattacttggaatagttatatcagacatcttaaagctatttttaattatgctatagataatgagctatttgagtaccctaaaaatttatttaaaggccttatggtaagacctgataagccaaagaaaaaactactaacagaaaggcaaatccattttttagaaatctctttggaaaatgaggagaaattacctcattatttacaacctgcttattttactaaagctttaatctacactttaaaatatacagctatcagacaatcccagctattacagctaaaaatttctgatatcgatatgacaagcaaaattataaatataagagctgaaaccaataagaatcatgaacaccatgaaattccaatttcagataaattatatccatacctaaaaagattgatattagaatcaagagctagaagcactagttcagatgagcagttatttaacattaatcgcttttcattagttactacatcaagaaataagaaaatgacagaaggacaactagttcatttttttcgccatatttctgaatttataggatttacagtaacttcacatcgattccgacatacaactgcaacagaagtcctaaagcaatcaggggatatctatgcagtgaagcaattacttggacataaagatctcactgtaactctaacatatattcacaatgatcctgaaatgctaagaaaacatgtcaattcgttgtagaaatgatgctacatagataaaataagggactgacgtagattagtaagtatgctagtctacgtcagccccgattttttaattaatccagagataactttgtcatcgggtgcaatttatttaaacctttcttttgataaagctcttagaactaaaaccagagtctttgctctcacattgataaatgacgatcacttatttattccacaatctttactgaatcttaggaccatgaataattttcctaagggtgacaaaattattggtataaaatcagttcatttagaagataaaacagaaatcatctacttatacgctgaatttacaatccaagtgcaacaaaaaaagaagtactcatcaactagaatataattttgtttccacacaaaaaccacttccaaatgatgagtacttcctaccgacatcttacaataaacgagcgagaaaagataatgattttactcgcacagggcaaaaaacaagcagaaattgccaaagcactgggacgtagctccagcaccatttctcgcgagctgaaacgacacgctctagaaagctacagtgcaacgaacgcacaaaacagctatttgaagcatcgtcaaaatagcaaagcacagcgcaaattagagcagcctgaatatttcaatttggtgcaagaaaagtttctgacagaaaactggtcgcccgaacaaatcagcgcacgattaaaattggaaaaatctgaattatccattagttattcaaccatttatcgtggtatttattcagggttgtttgatataggcgaacgcaaagccagtcgcaaactgcgccacaaaggcaaaacacggcatacaaaaaatcatcatgaaaaacgtggcaaaattcagatatccaaccatttgaacgaccgtcccatttcggcgcaaaatcgcagtcgctttggacattggaaagccgataccgtactgggtaaagcgggtggagcttgtttgctgacgctgacggaacgcaaaagtcgttttgagttggtgaagaaaattcctgccaaaaaagccgaagcagtccaaaaagccatgattgaattgctggattcacatatattgcggtcaattacgccagaccgtggtaaagaatttgcccaacatcgtttggtaacagaagcactgggtgtagaattttacttccccgagccgcatcaaccgtggacacggggaacgaatgaaaatacaaatgggttacttcgtgaatactttccgaagcaccaagacatcaatcagtggagcgaagttgatattcaacaggtggtcaataaactgaatttacgaccgcgtaaatgtttgggttggaaaacaccttatgaagtttacttcaaaaaaacgttgcacttggtttgacaattcaagtgaaaattcagttgctgatataaaataatttagccaccttatttctaaggcggctattatttgttagtaaaatattagctcattatcatcaatttcatctaaaattgagatttgagataaatcttccactatcactgatttttctatattgttaccacagcctttctcagtagtgctatttacaagtggtgcaatttgttgctccagtttatgagaccaatttcccatcaaatgagccagcgtatacatttgaatttttgtttcattcaatagcgtatcaccaactacaatacaagcaggaatatgtaataacgatagctggatataacacatcatggcagctgtaaaatcaacatcttgacaatgaacccaaagttgttgttggggattgtatttcgcatcaaacatcgcattaacacaaccaatcaccattacacccgaaccacaagttggttctgataaagtaacaaatccctgttgtgagatgattctatcacagtcctgtagtgtaactttcgccattagatctgcgatgtgagatggtgtaaagtattgccctctataaccatcaccaagattgagattcataaatactgagcctaagaaatcatagcgtttttgtgttaaagcattcaccgtaacagctaacaattctgctaattgagtaaactcagaatctgaatatcgtgccttagcatgagcaaagcgttctcgcaaattaggttctgcttgatctcgatacgttactaggtacatatcaagtgcagagagtgtaataaaatcataaaacacttctgaacgtcgataatgtggtacgatacgttgaaataagctgataaattgcttttcaaagttttccattagactactccttaaagtttacggagtaatccccctagggaattacccctagggtggaaaaattaattaaggctattcaagtttctcttcgaactcatcttcaaattcttcattaaagacttcctcagcaaaactgcgaatacccctatcatctatgtaaatattgcagtatgagccatcaagatttgcgatatatttgcccgcaaaccacattcccggctcaaaaaatgaaagtataaactcaatgtcaggaaaggcagtacaaagtgcttggaaccaaccatcaggtggtccccatggcgtatcaaataggcaattaatagatccattatcattaaagctaacttgacagctatctgaacatacattccatttacagccccactgttcatttgaccagtcataccaatctttgtaaccatgttgagctaggttagacagatattgctggcctaatgcgaggtttagccataatatactttgttgttcaggacgttttatcaaccagttgataaaatgacctacatcccagcgatgatgctttgccttagcatatatccgatcaatttcggacccatagatatactttttgagtagagggcgtgttaaacgtctatttggtgaaatttttagaaattccattgctctatcaccaagactacttgattcaatgcagattgattctggcattggaacgagtaattcaaagtctaaacaccatttatcactttcagtttttctgaaaagcttaggaataatttgtttagcttggatacaatcgcaaaaaatttgtagtttattttcacaccagtttggcataatgtactcctaaataaagtaggggtacacttgccttgaggcaatgtaccccaagggttaaaagataatcgatacataattcctaaaggattatgtattactatgaaagattgtgttgaaagtacctttcagcaaagagttaagctgcttcttcaaagacctcgtttttatcagccagctgtgagatatttaatgcatctaacatatattgacaagcttcacgagctttaccagaagcccggacaatagcccgtttatcttcttttataactcttatccaactttcaatatatgccgcattttgaggtaccgtatcaaatccaaggtaggcacacaaaaatgctccccccatttcggcaaccaactcctcaaaagcatagactttgtttccaaattttgcttttccggaggtaataccctcacgatcgagccttttagcagcaccagttgcatgagtcatttcgtgcaataacacactatgaaacgcttgagcattttcaaactgttttatttccggcattacaactaaatctgcactgggttgataatatgcccgattactcggtttcatttccacgtgtaaatccattcctttgataatctgccgaatatcagcaaaaatctcgtattggtttggatccgatgtaggctgtttaggttctgatataggatcgtacagttcctcgggtaaattttcacactggtctagattgaacagattgtgcttcttaatgaaaaagtgttgttcaatttctggattaccttcctcgtcatacacaatatttccctcctcatcaagtttttctctcttatcaggacggtagttcattacaacagtagctttttcacctttacggatatatccgccgagctcgttagctttttttgctgtaatccacttactctgtttgtaaccgtattctgcggtagcaatccagagtaatagtgtgttgataccagaatacaatcggttagagaccgcattacgaggtaatgccatattacattctggatgactccacggttttaaccatggtgcagtcccctgttccagtgctgcaacaattcggtctgtgatatgttggtataaatcaaatttagtttgagtgttcattagtgtttctccaaagttcaggtagaaaatggggaaacactattacccttatcgggcactagtttccccgatgggtggtttaaaatctcaacagagatagtttttctaggttcatcaaaaccagtagaactgcctataatgcagtaactacagataatttgttaatcagtattgattcaagttaaacataatcctcatatcgaaaattactttggtaatacaaagttacattatttcagatccattaaagtaaacgttgaaagctattagcagcaataaagtgataacttttttccgcagcttctgtttccgtaatcattccctgctccagcaaaacatgggtgattccattgaaaaactgatgtaatagaaatgaaataaaacctgttgtttcaacttttactgggcgacaatgaaactgcatatcctgccaaaktttaatrtcatcttttaaytgttgagagctcacaatttcatrtacaacagcagaratattaactaaattaccgttgtkattcagccaaatygtataacgattccaatctccttttctcattggctctatacaaatgtgaaataggtattggtaggctttattatttaaattgcggttatcccagatgtatttgagtaaatctaaatcgtgtttcataatgtttctccaaaagaaaaaagtggagaaacatcttacctatagggaaaatatttccccacagggtaaaaaacaatctcgataagcggtcaaattgaaataaaaaacctacaaatcaggcatgcaagtaggcaaaacgtgcggcattactacgagcagaagctatagcattactaataagctcttgtcgataaccactcaatgaatggtctgtcggcgaatagcttacgcctgtaatttcatcgctacctagttgaatgccactttccttatcagtaacggttgctacaaaatcagcatagcaaagtttcccttgtaggatttcctctatcattgcctcaaaatcgcagacatcaccacatagccaatcaacagactctgaataaaattcagaggatttacgtttaagttctatcagatagttttccgtgttaaatttgaaaatagtttccgtctgatacggtgaggcctcaataatctgatagccattcgattctaaggcacaggaagtatctttaatatactgacctaaatcttgaataaatccatcccacagggctttgtatttttccacttttgatgtagggaaataccactcttttcgggcatcacgatcatagaaaaatgccaaatcatctgctgttctaacagaaagctccatcgtattacaatgcgaatagcggtacccaaaactatttcgtatgatttcaaaatccacgccatagtgaggctcccaagattcaatgtgattcagcagattagaaaacattttttgtgtgcgtttctgaggatttagcttgttgaaaagattaattaacgtctccgtattaagcctaccgtagaatgctacgccatcgccttgacaatgagaaagtgaatactcaatgtttaagcaattaggaaaaccagctttaacaagagcgtgtttaaaataagtgtttaagactgagccagacattgcgcttctcctaaaattagagggaaacacattacccttttccggaaattgtgtttcccgaaagggtgaaagattgattaccacttatcgaagttaatcgctctgaatttataaacggatataggttgatcatagagttctgtttccgaaatccaattgtgttcaaccaagatttctctgacaagatacataaatgtactcatcaaatgacgactatgactaaacccgtttccaccaacataagcaaaccctctcagggttttgcgaattcctgctttaacaacaaggtaagtaatatcaacctcgccataagacgggcagacatcaaagcgagaaaaaacagaaaatgctttgccaaacttggtctcacgctctaatttcacactgaatagatcatgtgcatggcgtaaattccaaagtacactgtataagtgcaaatctgtttcggtatattgaatttttttacgagccataatgtttctcctaaaaaataaaagggaaacattacttccctctggggataatgcctccccttgtgaggtataagaataggatgtgaatatgaagttgcctatgctcgactaacaattagcttgccgttctgctcggacacactcagaaagcgaaaattaagtccttgccgagacggcatttgttgcataaatcgcacgcttttgatgtccttatctcgattttgccacgcttctaaagctctatgactaatttcttgctgtaaggcttgatgctctgatgtccattcattaagtttagttggtaaaacatctccaatacaggaaagtctaatatgaactaacatacatttctccagaataaggggaaatgcattccccttaagggaaacaacatttccccgatgggtgagttaaattagattaaagagagctgagtaccaaaaacggcagccataccacatacaaaggcaataatggcagccaacaaagtccagaaaaacatcttacgcttaatgcgggaaatttcctgttcatattcggctgcttgttcgtctaagcacatttgcagttctaaggctcgcatttcatcttcttcagcaatccgttgattgatgcctttggtgacttcaacatacttgcttttggctttatgtttcgctgaaacaaaaatattacctagcttgttgccaagtttccaaaaaagagaaggttttacggttttggatgattcaaacgggataacatcccatcctgcggtttgttgactcatagcgagttctcctaaaagttaagtgaataaaattcctcaggagatcgcaattccaagggaattgaaatatccctcggaaggtaggtgtgtaggtagcattcctgcaaatttgcagagttccctttcagaatgctgggagacattttgggtaaataactcaactacctctaaggatagccgccgcttttcaagagttatgcgacttttaagggctgtatctacagcgtcttaatgcttaatatcatacgaattcctccaataaaatcaaccgtttttttgttcaaaaaatatctcttttttgaaaagagtttttcctatcctcaacataaaaatctcgctaattttctgcttatttgttcgggaggagagcgtgatgaaagtaagtagatttctgggatattgcagtatagtaacaggtgtgttttcgccccttgcacaagcacaacccaatatcatcgtctataccacaaagatgtaccctattcaaaattcacaacttgcttcccagatttattatcttgaccaagtagagaattttgaagagtcaatcagtcgaaacctcagtaaatcaccagagattgccgaacaagaaatgcgtgcattctttaattcagcagattggaaagcccaagagcaacaattaaaagacgcttatcaaggcgtgatcagtggatggcaaaatggcattaagaaagtacctgcggtgttttttgataatccacaatcttctccgagtgtgatttatggtacgactgacgtacagaaagcattagatgaatggcataaatgggttaaacaacaaggtgaatcaaaatgaaaaaaacgtttcttacgatactgatctctgccagtttagctgtcccaacaaccttatatcctcaaccagccagagcctcattgaataccgcttccattgctgcatcaagtgcctcaacaagctgtttggaatataaagttgttggaacctgtttttggttattttgtacctactttggatgtaaggttcgcacatcaaccaaaattaagcattatttacctgaaatggttgtttcatcttataaccacgatgggcaaacgccatggacagaattacaagctctcaatcctggtgtaaaaggtggagaataccgttctccacaacgccaatactctcaactcactttcaaaaatgcggatgcgtttggacacccacaaggagctatcggtcaattattaggaaatacggggtactattgtaaaactcaaactacgccatttatgccttactttttgagtgggctggatttttttgcctggcgtgaaaatatgccggaaatgttttacccggaagctctgactccgggaatgcgggaagttggccgtgtaggcgatagctggggaaatatttacccacgttccggttgggtaacccaagcacacgattataaagcctctgcgaccattgtgcagagagtggcagacattgtgagccgaacagctcagccacacatttatttcccagcagccaaaacaggtggtgcaggagaatggcctccaggaccggtcgaagagggacaagcaagaacacataaatggcaaatactttaccctcaaatgtcaaatacctgctctgtttttcctaatggagggcaaacagatacctattcttctcaaatttcaaatcaaggtgattatgcttgggcattatggcgaccttatagttgttgcaaacgccgtgggcaaacattcctttacagtattgattggtcacactaataacattgggagcaataatgaaatctcactttaacttcaaaaaatcccacttacggatcacgacagcattattatcaagtgtatcaggactatcttatgccgattcgattacggataaactggaatttagtaagtcggattcgattatttcagaccgtgttttttaccaaatcggcggtggaatgggttatatggctccacctagtcgtggtaataccaaagttgttgatttaggaattggttggaaagcgaatttaacctgtggtaattttgatattaaaacgaccattaaaaatgatttaaacggtctcaaagacggctttaaagatttaatggggaatgtcattgattcagcgaaaggtgcggttgcaagtatgcctgcaatggtattgcaacgggccaaccctcaactctacgatttactcacaaatggtatgtaccaaggtaagctggatttcaaccgtcttaaaaccagttgtgaagaaatgtccaaagttttagcagatcatacactgggaggaaaatgggggcaagcagctgatttagaaagctataagcaaattacctcctctcaacctgatgcaaaacaagctcaaaaagacctggaagataaaaaagggaaagatgggcgagtttggataggaggtcagaaaaaaggtggggaaaaccaagaagctatcaatgttgttggcgatgttgtcaaagctgggtttaatttactgaacaaacgtaatgccttagataccagtacaatttcaggttcaagctgtgatgggaatctttgccaaacttgggataatccacaaacagcagccgattttttaactaagattattggtgaacaatctatttcgacttgtaaagaggattgtggcactaaaaccagctcaaaagccggtgtaggcttgagtccggaaattgaggaagaacatgttcgtactattgtcaaattagagaatgtactgaatatggatgtgcctaaggctgaattgttagctgatttgagttcaactactgtaccagtaacaagagggcttattgagagtcttcgagatgatcctgatgttgaggtattaagccaacgcttatctgcagaaattgcgactagtaagataatggaaaaaatgctcctggctcggcgagcagtcttagctggtatgcgtgagccaaatgtcgctcaaaatgcggatgcacaagtagaactggaaagagtactcaatattattgaccgtgaaatttcccaagtaaaactagaaatggatatgcaaaaaatgatcaccggcaatacggcttcggtgattttgcaaagcaaatccgaacgagaagctcttgctggtgctcatagtttatctcaagacagtctggataaacgtgttcaaggacttgaaaacggtaatgttgcattaactgatttagaggcaggctctaatattaacctctctcgtagaaatattgcattgagtatcccgaatattccgaatgtagctgctctcatacctaatctgccaaatcgaggtggttcaggtgtaggtggaaatttcccatcactcgcacaaatcagcggttcaacgatggatcaagcaacaggattactacgtaattttgaaggctttatctctaaggctcaatgggatgtaaatgctcatcgagtaggatatggttccgatacaattacccgagctgatggtacgatcgtaaaagtaaccaaagatacggtcattaccaaagaagatgcagagcgtgatttggcccgccgaacagctatcttcgcaaataatgtgagaaaagagcttggagattcaaattggaatgcgttaccgccgaacgctcaagctgttttagtgtcttatgcatataattatggttcacttgctaaaacaaaaagcgtacttgatgcagccagaagatcagctcaaagtggtgatatgaatgctttagctactgcaatcagaaatcgccaagttgataataatggcatcaatgcacgtcgccggaatcaggaagctgactatattcttggtaaaaattaacctcataaggagttacatttatgcgtaaattattaggtattactgtacttacactttgtacaacttcagcatttgcaacggataaaaatgtggtattttcttgtaccagcacagaaggtaaacctctcacagttaaacgggtaggaaatgattacgagtattcgtatgataaaactatcttcaaaaacccaatcaaaaaagcggtgaccaacgatggctcaattatcgctagaggatcaggttttaccacgtatgcattagaactgaaaaatgatggtttgaagtatgtagttgggtttgttcaaccaaatggtaactcaaaagagtttattgagcctggagcaacgattagccgtgataatgatcaaccaagcattggctctgtagattgtgatccttacaaaaaaatctattataagtttgatgttcatttaatgaataccttgtaatgcgataattcaataatatgggggaatggcttgatttttcatcccccatactctattatatagatgtggtgctagagccagcccacgttaaaaaatacaaagctcggtagatgaactattgtggtgccagagccggcccacgttaaaaaatacaaagctcggtagatgaggccccttaagtcgtaagatttaaggggttttgcttaggatataaaatggatattacaacacaaaatattgaacttagatacttatctgagcagttttaccttgatgtcgctccacatctgaaagaaattttgcttaaagagactcgcccatactgtgttctattagttagagttaaaaatttagattttgccctaccattgcgttctaatttacctgaaagagaaggagttggaattaaaacgatacctaatcctcaggaatacggcaaatttaaaggaattgatttctcaaaagccattctactgacagataaaagctatttaaaaacagataccgttcagctcaaaaacaaatcagaattgttgaatatccaaggtaatgagcgtagaattgttcgtgaatttaagaaatatgtgagtgaatatatcactgcacataaaaacggttataaattagatcataaatttgaatatacaactttaattaattatcatactgagctgaaaatcagctaattagaataattggaggagctatgaaatttatcgatttcggaaagcagctcgctaacccagttaaatttatcaaacagaatactgcatttttacctaagcctattcaacaagtggtcgtttttgcggtaatttttgcaggattgcctctatttatcttgggtttctttattctcagaatatgggcttataagcatatttctttgtatagtgaatataaagatatggctaattcagaaatatcgtctaaagatacagatttaaaatcacttttttctgatgatgaagaacaagaagatgatgaatatcaatatgggtatgatggaccaggtatatatctaggtaattaccgtgttgatgagtaaaagtaaatagagtggtatataccactctattattcagttgttagattatttccctatcttggaacccgctgttttagagtctctagaaccagtagttaaatgacttgcaaactctcccatttttactcctacccaagacatactgcctagccaaatcgctggtaagaccaagaacatagaacccatcacaaaattcacaataatatcgtcttgtgtattttcaaggaaataagggtttattctgctatgtgtgcctgaatcatagaggaccgacagcaaccaagagtcaagccatctagctagttcccaccaaaatgtgagtgtaactaatgcgaaattcacaaaagttagcgtaaccaatgtttttaacgaataaccactcataaccataattaaaggcgtgagaataatcaatgccattaatgcaaatgaatgcaccatcggtaatgcttgccgcatcgaatcaaaagcagggaatgctccgatactgcctaatgacagaccaaacattgaagctgttttagtcacttcatttgtaaatgatctgtctaaatttcccccatacccgggataaactttccctctcgaaatatccatattctcagctcgtaatacggtacgaagtatggattcatcggaattttctttactgctgaaaaaatcaatcacttttgcagagaagttctgttttacatcatctaataaacgatcttttaaaccattattcgccgtatcccaccactctgcacaatttggaaaaccaccctctccattattcggcaatccattatcccgagaagcattatagggaaatagactatgaggttgttgggctcgataacggggataaagctcgctatttgcaatcaaaatacggccacctaaccagctagtctcacgaacctgtgctgggctcaatgaaagttggctattttgaattttctgacgtgccggtacatagcattgttgtacaaataagcgaacctctgtcaataatgctggattattgattttctcgtgttgaacttcaaaacgaacttgacgtaaatccggtttgcagggaattgaagctgttaaggcgtgtgttacccctttgttgatttgatgaaataatccccaccagatagggactctcgcttgttgatcacccaattcagagttcatttggttataaccactatcctctggtgcagttggaacacgataaccacaggctttagaacgttctacattcaactcaatattattcaggttgatcggtatcattggagctaagaccaatacaacgacaaacatcgccgggtaaaatttgaggctgagccaagtaataagtaaatcccctttattaccttcgtcctcaccttgttttttgacttccatccacgtactgattaagacaaaaatgagaggcagaacaaacaaccctgtttgaaccaatacagcgaaaatattgttgttgatgatccaagccagtaaggtaagaaagtattctaagtaactatctacggtaaaggtcatctcatcctccttaaagtagatacagtaaattaagtccctcaataattgggatgacagataaaatcattaacctggcttttaatggcatttgcccttttcgattaagttgtaccatcaatagccaaatagctacatataaaacaaatcgccatcccaaccaggcatagcgggtttcatagaaccacgcttgaaaatttgtggaaggaaaataggtcattgccaaccagccaacaacgagtagtaataaaataataccgatgatcatcaaggttatttttaatacagtaataacccttgtcattttaggctttgttgtatcagacttcattattatctattacctcgttatacacagagttatccgcaattgatgtggataagggtaaaagattacttttcaaaccgagatactgagtaaggaatgccgaaaaccaataagcatccacatgatcagctatttcaataattaaacgagctgaccattcactgttattggaagttggtagcaaagaacgccccgtcacattaagtaataagtgaacagaaccctgctcaccagaaagttcgatagcccagtgattttgcacgacacgatgagggaataaggtaatctgtttcccaacgccgatgagttggcgaatttgttcacaaaatccaagcaattgagtttctaccgctggagatacaactcctaatgaggatttttgtgggcctgcattaaataaacggtaatgttgtttattcattagtgtattcctcttgctttatcaatccgagctgcaacctctaaagctgcatcgagttcggtatagccgtgctgcatcatcagttgcttacgttctgctttttcatgtttttcagtcattcctaaagctaaaaataagctaggcggtacaactcggaatagagcttccatattcgttgctaataccacgccctcggtatatttacgatctgattttttggcagataacaacatcgttttctgggcctctgacagtttccggaaacgattgatttcatcaatttcactggcagacacattcaacaattcccaccattcgaccattgagagtaatttcgccgcttcattcgggaagtcatccatattttgagtagcaagccatagccaaatccctagtttacgccacatttttgagcctttaactaggaatttagctaataatgggttggccgtgataatgtgtgattcatctgttacattcagaatcatccgatcactgtgttggtatttttcaccaagactgttgatatggttaatgagtgaaatataggaaatggccaactctgcttcatagccttcccgggcaaacatagctaaatcaactaaggttagatcagcctccggccaaattgccccctctcgattaaaaaattgcccatttacaccggtacaaaacatttctaatgattctgccatttctgctaaacgggtacgccgttcttcacgagtatgctcatcatgacttaatgcttccaaagcatttttaatatcttcagtcagcgtttgtctgccttcagatttggtttggcgagctgcatttaaaatggcacgacgaatagcagcacgatcagcacggctcattttttcatcttctttcttttcacctccggtgatcatcaaacgtgccgtcagctccatttcggccaataaatctcgttgcatatcaccttcatcatcagtgtcatcgttatcctcaatgtcttccggcacatcttccgggtttaattccatatccaatagacgatgtgcttctgaaaagagtggtaagacaatgccgctgtttggagctaacgtaatgcgatttacagtcagtccgaaacgttctgcatagtccgctaataaaccaaatgaatttcctgcctcaacaacaaaagtccgtgggcgataaacggccatagcctgacataattgcccacataacgtagctgattttcccgaaccggttggacctaataatagcttgtgagcatttttggttctgtctttacggttaaatgggtcgaaattaaatggtgctcctcctcgattaaagtaagtgatccccggattcccagtcccggtatctcggccaaagataggtaataagtttgccaaatgttgtacaaaatagtacttcgtgtagtaatgtgatttggcatccatctgcggattaaaattcattggtagccaacgcaaatagctgttaagtggggcaatttctgcattttccttcacgggttctaggttgttactgagcagaatcgttctcaactggcgagaacgggtacgtagctccttttcatccttacctcgaacgtaaaatgcaatagctgcttgatagagtttatgcccctctttaagataagactgtacagtttgacagtcttcttttaggtatttcgactcaaaattttcacctaccgctcgactactaattttttctaaatgtgcctccaacttatcctgtggatggatgacgatggtaattgccataatggttgattccggcaacaagtcaaataatgcattgatattacgcccacgagtaatctcgccagtcatcaaccccacttccggttgtttcctcaaattattgactacaacaacttcgtgcggttggtcatcaaaataccaatagttgccttcatttttcggttgagaataaaataaatcttcactgaaatcgttaaacgctaattctggaagcccgtcatttgaggtttgtttaccaaaaagatggtagcaatcattgttgcttaacccctcaaaattaatagaaggattgggattaaaccaacgtaacagccattgacgaaattgttcgccatccagtcgctgcaattgtaatccagcagttgttagagctccatttatgcgagaacaagcattgttcagctgctcgacaatcagattttcattagtgtcattggatttatcaacataccgatagatcaccattttggtactacgtatacgaccagaccaagctgtatttgtcactcgctcatcaataaaaagcccctctggtttaccgatatccttgaaatgcttggcttgtacccgtaaccattcttcgctaaatgcactatttttagcgataggcgagatataatttcgtagctgttcaatataaggctgtaaatcatcgctgtcttggcaataaaattgaacaacgtacggatttacatccaattcatcaaagctgtcttgcaaggcatctttgacaagattacgtatccgacttaaaaattcaatactacggccagcagtaccaatcggcttaatatcaaatactgccccaacactacgggcatcatcaaggagtatcacaccgtgctcattcaaatattctccccaaggtagatgatcgataaaggagggctcttgtgagtataaccgacggtgatgctgtgactgggtgagttttccactgcgttttaattgttgaacctcgttatttacctcactcattttattttgaatgatgtcagactcaccggtattttcatttggttcacttgatataacccctgctttagtcggtttgaaagaggaaaatacctcacttaaaaaagacatgattaaagccctcttgttctatcacccggctgagcatattgaactcgtccatagaaaggtagtactgtagaatatcctggaatactgagaggctctccggaacgagtttgatgtgggtacacatacataatcagatccggattaggtaaacgagggaacaagttattaatttcattttctgccgtacgggtataggctcgttgctcactattaggaatataatcgacagggtcaagtgttcgcccttgttgtgaacggtataagtgtagatcgttattactcgctcctttatcccaaatatcccgcatcgtactgccgttagtaggtaataattcttctgttgatgttgtgcaacctgttatcaataaggcacttatcattatgcaaaataaatgtttcatcgtttgttccttctaatccagttgtgaattcgttgattttgagccatatttcactttacgaccttgggcgttgtaatcgatttcaatctctttctcgatatgaatagagacacgatgacccggtggcacatatacagcatcaaagttttcagcaaaacgttttctaaaccagtcagcagattcttttaagccgcctccgatagcttgtcctaagatgaacttaccctgatcgccggtaacagctccaacaacactacttccatcaacaacagtggttgtttgtgactgtgagaatccttgggcagcagcacttgcagcagccaaaaagaaattcgttcccaaatattctggggcattggttttccgctctcctggaacacaagggatacccgaactatctgataaccagccaatctcttcgccattccctttattagaggtactcacaatacgtccatcattgaacacaaaagtcatactttttacactgcctctaacacaggatagtgtccagtcgccagtagcagtacctgatacaattgctccgtctacatcaggtaattcaataccattagcaatgagattttctcgaccaataagtactttgaacggataagcatccgatactcgattatcaatcgggatacgtccgatgagtcccgtcattgcaactgaatcaaggaatgttgaattacttggtatggtatatactgatgtcatctggtttttaccacgtgcgtttccagccgttccttgtgagcttgtcacagtatctgtttccgggaaaaacggcagacctttcttttcgttatttcctgcagattgtcctccattaaaatctttcggaaagccaaatttagttgctactgtattgcctgacacaggttttccacttgcatccaaactaatctgatcgcttggttctacccaatacattccactggtatccacgttggacatagttgcaccaccgataggtaatttatctcctgctgttccaaatcctttattcggtaccgtattaggctgagcctctacctgaggggtagactcttgtgttgttggtttgttattaacgagagtcgccatatcaaataattgcattttcaaatctgcaatctgctcttgcagttttcgggtttcattatttaccgcatcattgatacgaccattcactaaatcttctttctgtttgagttggcgattttcatcaattaactcatccatacgacgctcattggatttaacggttgtcacaagggtacgcagcgtatcaatcggcgtatcaccttgaatacccattgttctgacttgttcaggtgttaaatctttaatggaaatatctaaaatttcctgttgtgtcggttgtggaactgactcactacgtccaaataaggcatagacaattccaccgactaagataaatacaatgcccagtatgacaaataaggctttattcgctttcattgcctttcctcctacttcgccgattgagccggtttagtttcaacttttgttgttcttttcacttttttactgactagtttgactggacgggtttccggaattaatgcgttattagcatagccttcggtcactaaatacagggttgtggtatcttcattttctccgtaccccccaagccaattatgctggaaagtcgctgcataaaattgtccttgaagctctcgagggtcaagcgtaatttgagtgttacccttattttgcaaacgaatagcggtaactacatattcgtctaactgccagctaattaaaggtgttgcttctattgaataagccggtagcagcttggtaatttttttaggtagacgatgtgccacacgacgcacaccatctaaaggttcaactgtacgtagtggagcataaagtgattgtgctgcataacgggtcaatgcggcaggtactggaagctgaggacggctattcgcaataggcagatcagagctttcatcatctctattgcttgaaaaagattgtttttctaccgtaccgtcaaaaaccactcgaattgcctcttcaggattagcgactttcgaagctgctgttaaatcaaatagaaaaatttcaccggttgtaacatcacggaattctatgcgagtggagggaaatgtttctaatgcttttaaatagacggctccaccggtagattgaattcgtagcttaccgtccagttctgccggataaccaaccttgacatttttatcgacaaaaataattcgttctttttccacttgtaacgcaacaggaagtggttttctttcccatttcatcaatacatcagccaagctactcccagagaagcctataagcaaagagacgagcaaaattggtagacgtttcattattttttctcctctgtttttggctcaacaccttctaagagttttggaatggagtgatagcaattaaaccctaatccccaagggttttgagcagaatcgacatccattctcacaatactgataggaaaacgaatataaactcgttttaccggctgtccttggaaatgttcatccacacttaaatcaagattgacagcccaactatcttcactgaatatggtaactttatcttcactatatcctctaccggtaatttcatacaccatacgggttcggctgcgtagttcattgttacgcagacgatctttataatcttgtcgtaaaaatgcttcacagtgtggtgttaaaaatggtttgagggtggtgatatttttctcataatcctcttcgccatttgtcatccaccgattcatttgctggaaaatttgataggagaatgcataaattgttggtttaggaatttcccaccaagctcgttggctcccagcacgcagatctggtgggttgtatatcgtaaggcgacttgggaaagtatagattacgcctgccagtaccaaaataataatgaaaaacaggaaggcaaaaattcgagtcgttttgatatgtttatctttttcgtgtaattggctttttaactggctcatttgttatttccttctatatcggcgaatagaccaaaacccttctcgttttataaacttatgaccgttaaagaggtcatccattttcttttcaactaatctatttaaataagcctctggttttcctcgtttaaccgcagcgacaataccttttccgattaagacagttgcgatgcagagcaacattgccattgccggaataagaagccaaaaatcagttaatatccacaagaagagaccaacaatcagacctaacataaatcctaatccggcagatatgccgaactcactaactgtcatcccaccgtaaacggtagcttcacgattaaggcgggtgggaagaaaaggaatggttgtatcttgttctgacatattggtctcctagacattttaattagaagagtccgactgcaagtttgactaaccacaagcagaagaaaatcacaataaagccgataattaaggcgagaataaagtgtccccaaccttttttaccattttcagatgtagcttcgttatagatgccaatcaatgctttaacaactgtcaaaatggctacggctgctaaaataacagctccgagagtgacaagacctttcagaacaatccaaataatttccattggatctttggtattactatccacgcctggaatttggaagtctgggattttggaagcatcaggaccggctgcaaatgcattttggagggaaccccagaagaagagcattacagccaaataacgactatgcagatgtttcgtaagagatttaatgcggttcataatagacctcgaatctaatagataaagaaataagtaacacaagctaacagtgccactcctttgagaaataaaactaaaagtgaaaaaggacttttatctctaaatgaaaatcccttataaccactattcaatgcccaagcgacggctaagagcagtaatgaaagaaaaataatggcgatcatgattttcaatctaaaagggtcgataccgctggcaacagaaaacgcattcgcaggggagtaagacatcactgcccccgtaatttgctataatcatcacttaatgtacgtagtacattcggatcacgaggtaatgctcggcttggattgatatattgttgaattccttttttgacggtttcaatatcactgtgaatagcagaatagttaaagtattctcgtgttttaggcgaggctttagctactttttctgctcgttgaagtgataattttgccgcttccagttgcttaattgcctgggctaattgctcttgttctgttgaagcaagtgctggcaagcaagataaggtaacaaggacaacaatacctttccttaaagatgttgaaatagacatagtgcacctctatttttagttttacttcaggttaagagtgccaaaagcgatcctaaaatttaatggaaaactctgttaccgttcagaagagaaattgcacaaaatagtaaatggtgagaaagatattattctatgtttaagctagtcaattaagtagtatcaacaccgaaatcttcacgctttacgatgagataccagatgagatatctagcactgttccttgtagttttcccatatgttgcccattctcttccttcagcacagaaagtggggaatatttgccatgcagaaaatgctcaatataattacggaggtctttgggaattaagtttaagaggaaagttaatctgtaattattggcaatttctaggcgatgatgagcgaaaaaagatagagttacaattggatgagtacggggaatttcctatttggaatacctctgaacaaatttctgaacaaatcattgaagatgatgaatatccacaatattgggaagtcgaagactgggaggattctgattgggatactgagtcagaaaatgaagatacagaggcaacaacagaagaataagcccccgcatattgctaagggcttatgaaatttacaagaatttcttgaaactcgccgcagttatacagatggataaaccaaacaaacaggctgctgggactaaaatgatgttcggatgaattgaaaacgggatagataaataaagcacccaagctgtgaccatcattggcataatataacgtctagcgtgatggtataggtaggctgattcccgcccggcaccaaattttcgtatatctcgtaatgacagtccttcggttaaaccggaaagtgcagtcaataaaaagagtgggctggtaaaaacaataataatgaggcgaataataaaggtgatcaccacataaataacagattcaatataggctctgccgtagtgatgtacccactgttccatactaccattacccggtgaagttaaccactccttaacacccgtataaacgaataaccagttatacacgttttcaataattgatgttgcaaaagcagtagaagacttggcaaacaggctttgagaaaagtcatccgatagccattgcatctcattgagcatcatcgtttggctatgcaaatgcccttcttgcggccaccagaaagcaatgcctatccactctaaaataatgctgaatatgagagatactgcaattgcagcaagcgacatatttatttttccaaaaatcaggttgattaaacctgattttcggcgagctttagtttcttcactcattgcaaactatcctctctatcgagctggcactggacaaggatatagccggaaggattattatcaaaagcaagataaaaagcgaaaatatctttggatttatccgagtgacgcatagatacttcatcggcagaccataacgaaagcccttgatctgcgaatttttcggcaaactgatggaaggaataaccttgttcaaaccattcaataaaataggattgactatgaatcaggagttcttctgcattatctaagccacaggaagctgaaaactccccattaaaattacggtatttatttggtaaatctaatagattggttcttttttcctctctcattttggcactactcatcattttcctcttcatcaatatcgtaaggttcatctatgccgaaattatctacttgatggtctatctgtgttttatattgaggctccgacatcgcttcaaatgcttctgcaatgtctcgggacggcgtatattctgtaaatgccggttgccaccaattttcaacaacgtgatagtttttacgcatataatctgtcagctctcgtaaagattgatgcatcatatcatctttatcgacagcaggtaacggcattcgaattttccataatttactaccgtccattaaagcgaatgcttgtccttttggtaaattggtaatgttggccggaaccaacataggaacggtactttcgctgatacgctgtccggtattggagctaaacgccttatcatcgtcaggattactggagtcagttgtactggacgtgaccgtgctacgtttaatcgtcacttcgtgtaactgttttgtgagtaattctgccgtagccggttcttttaccctcagcatatagagtgtattgaagttacctaaggtttgtcccgctttcggtttactgccgatacgagcttcaatgtcggagagtgtttgtgtataagcagttacttgtattccagcaccaccgcctttgttgatgagagggataaattcatcacccatcaattcattaaattcatcacaatgaagattaattttcactggtttggatttttctttgaatgctcccggtaatccgtcatttgtcccaaatttatataaatgacctgccattgagactaagtcagcaaacatactgtttcctacagcggccgcaactgtcgcatcagagagagcatctaaaccaatataaacgattcctcgtttacgaataatggattcccagtcaaaaatcggacgttcatccaaaatatcagcataatccggggataacagctcagaaattttccctgtcgttaatttttccaataacggcaacaatgaggcaacaattttatcgaaataggtacggtcatagcgtacagcactggcaagtccttgtagaattgggtcaaagactgcactttcagcaatgtacttgttgatcacaaaaatcagcggacggtctttcattccgaaaggaagtgctttttcatccagtccagcggcgatggttgctaaattttcccaaatttttggatcggttttacgaatgaatttttccgcataatcaaggaataatgaatcaatattttgtacaaactgggaaatttgaacatagtttgggcgatttcccaattcaactaatgcacgtgcgacgatattgacaaatcgccaagcgaactctttaaatgccgccgagttacccgctccacttagctgtcctgaaatacgcccagcgacttccgaaatacgattaaagcgtcctactgggttataacgggcagaaatttcgggataacctagatggaaaacataaaactcatcttctcgccccgctcgttttgcctccgcatacattcgtttgagcatatcggcatcgcctttcggatcaaagaagactaccacttcacgctcatcagcagttttacctcggtggatatcctgggtaacaaagacctcagctaaacgagttttaccgacacgtgttgtaccgaatactaccgtatgcccaacccgagagctaacggattgaacgacatcaacctcatccggctcaattccatggatagcaggaataccctcaacaggtggcagaggtctaaccagattccaccggctatcctttgaggtaagatgtgttagccaattttcgtgtcgtttttcatactcacgagccattttaaatagcttagaaggctccagatattttgaaccgttatccgaaaaacaatcgtgtaaccgttgagtgtgaataggtttccattcaaatcccttaccgacaaacagatacttattactgaccggaatttgcttgcttgtcattgaataattaggcaaacgtttcaggttgcgatggtaacgcacaatttgccaaccttgttttgcccgataaaagctcaatgctccaaaaccagctgcaatactgtaaccgatacttggatggagtgccaaagaccaaggagctgcagcactgacaaaggcacaagaagcgtgaaccgctgccggaaaaaattcaacaggaggtcgtaaccacgcctctaaggtatgtttagcagacattattgtgaaactccgctttcagtgattaagacagggtaatgtgcaataccaattcgctctgcaaggtcatctccgggagttggtaatattctcagttccggtacaatgtctcgtaattgattaagttcggagagtgtttgtacattcactacaagccctgttgcattcaacgtgatcaacttctctcgattttgttgtaaccactgagctgaggtattatctgctccaattaagaaaatggcttgcattccggttaaatcaaatggtttttctttaatagtcccgggagatagtttatgggaaacaatgggtaaaatatcagcctcactcactgaggctgaaatggaattcggatagtttggtgcattttcatcgtgttccggttgcaaagattcataaaaacgtaccgcactttcaccaccgaaatcagcaatcacggttaaatcagcccaagagaaatgggacacatataaactaaacaataatacttttaccttgttttgcatttttacctctgaagagtattttggggttctacccaaaccattgcatttttaggttcaacccaaatcattttattatccggctcaacccatttgaccgattttcccatttggcttgtgggataaacgaaagctgcaactccggtatgaatatgcccttgcttggagacagtcataaaattggcttcttgcttatgtgctaaaaaacgtcctttttggtaattgagaaagtctcttaccgtcatccaacttttcattccattacgacgcatatttaaaatgtcttctttagtagctttccccatcattgctcgatgcagcccatctaagccgatattatgagccatatataaattctcatcagtaatagggatattacggagttgaaattgctcaatatgccaacgtgccaataatgccgttgctaaggtattcgtatatttatctcgacggggatcggcgtaagaaccccgatttttggctgtaatcaacttcataccaagttgctttcccctctctgtttcagatagccagttccaggttcccatagtaaactgcccaacaccggttgctcctgttggtgaaatgttgccataccagccatcttccattttgacaaaacctcgtagcattgcttcactcacctgataacgttgagcagccatacgaatatagctgtcaatttcagaaccaaatccattgaagggctttgcctgagaaatgctaatgttggaaagaaagactgcaacaatgactaatacacgagtgatgtccattcaccatcctgtttgatttggtaagcagcgggcatttttcctaacgaatatctcagccaatagcctttatcgtggttaagggtaatcaatcttttactgacttttattgggtcaatattattgtcggcagcccatttacgaatatcattatcggagatgttttgcccaacaatataaatatcgagaggtgtttgattatttgcgtaagagaggattttcccaagatcacttttacaagaatcgcagttatcaaaacgggtaaaataaaccacacgacctaccgattgagaaatatgtggttcaacctcaaaaggtagctcattcggataaagtttctcaaactcctgacgataaactttgtcaaaatcaagttcttttgacactcgttcataatattttttcgccaacatacgagcatatttttccctttcctcagcagttcgtgcttcgatacctaaagcagttaacggatctagatttggcgaccacatacctcgctcacctttcattaattcggtataacgactccattcttcaacggtcaatccccattctttagcctgttttaggctatcacttaattgtgattgttgatgttggctttgtttctgcaaagtcgattgtgagctacttacggtctctgtttgcatattttgagccagagtaggtaatgcaaaggacaataaaagaggtagtactgccaacggtatagctttacggcataaattaaacttcattgatatttccctcattattcctcaatgacctcggttttaattgttgtcgttgtaacggcaacagcaggtttatgagggttttggaatgaactttcccgagctttaaagcaaatcgtacgggatatatcattaagagttagttcataagcgggacctgcaatcatttgtagagcttcatataatttcatcggaccgaattggtaatgaacttttggaagaggtcgggtaaaaagtgtttgaaccgcattaccttgttctccgataggtggataacacaaatctaaacccgtattagttaatgtagaacgcaaaccttgctggacattcgcagtaaaacgatttttaggattggagactttgactgatacgacttgttcaagcagatatttttgaccttcctccggagcaatactgattaaggtgtagcgtccgtcacgtaccacttcggtattcgaggtagtctgttcttggtaaatatctttggacacgatacggtcttgtggaggtaattgttgcatttgaggtgttagcaatgaatcaggcataggtgtgatttcatcactattttgagctgtatcctgttgatgaacacaaccacttaagccaagcataaaaacagtcattaaggatatttttgttttcatttaatctctccaagtatgaaaggaatctagaccaactatggcgaagtcattgctgattttgaatgatttattctgttgttgattgagagaataaaaaaacgccatcattagacggcgtttgaaaacacaataatgtgctgtgttaatcggatttctccttagtattcataagaaaataagattgttgtacagctacgatcagcttctgtgatgatataaagactttcatcatctacatcgtagcgagctacaattctccctccgtatttcattgcttcctgattcgctaatttatcttcctcacacaaattgccccaatcaccataacagtaacgattaagcaattcaaccaaggcattttgattgaaacattcagcaacagcacgagttgtacatactcgaccaagttcaaacgtcatacatttctcctaaataaaatacggggaaatgtcacccattaggggagtatttccccaagtgggtggactaagactgcggcaagagtcgtttttagtaaaaatttgcaaaaaattaggcagctaatttagccggcgtcatttctttacgaatcttgtctaacatttcattccaatcatctatatcacagattctttggcgattaatgtaaaaatgcgtgtctattgcattgatatagtagtcaaattcaactaaatctgaatcttgctcaatatctaattcagtacagaatcgttgaattaagcgagagatgacaagctcctgatacagattaccgaaatgtggtacagtttcaaattctttggcaacaagccaaaagtcttcaatactgacaatatcgctatattcttctaagatggcttcccattgtcctaaatagcaagagatatcatcaaagtcaaaaaaggaatcttccattatgtttctccaagttttaaataaaaagtggggaaacatacctaccgagaatgtttcccgatagggtgtatagtcaatattagcgataaatatcaccgctcactgtgttaattttacctaaaatagatttacaatgaatgtcagcactcacagttttcacattcgaggttacattaccatccactgtgacatcaccactgacagttgaaacagatttggcatcgcctgttacacgaacattttctgaacctgcattgaggttggttacattgccaaatacttcaatgttgatagtcggagagggttctaatgcaattgtttgtccatcaacaattaatacattattgccggcagccattgagatataacctttatttatcccaacaactgtttgcactgtactattaatgatttgaacgctgttgatctctttgcctttagagtcaaagacttgtttaccgttgatataaataccttgtcgattcatataataatcctctttgtattagatgttaaaatgctcgatagaatacgatattaccattggaaatttcgttgcgagcagcctgtacaaacgtagttaattttgctaaagcaggtgtattagtttgctctaatcctactcgctctaacatatctagatcttctatgttcaataccaccgtagcatctttccagaatgtctcaataggttgatagtattccggttccgatgaggctttaatttcttttttgaagaaatgaaaagccatctcgttgtgaactaagaaaatccctctatcatcggcttcagtccaacggaaaaactccttggaatgttcaattaactgaatatctgtaccataaatggggttatcccaatcagacacaatgttatattcacgctctaagcctaacgaattaaaacgttcaagagagattgaatacgctctagcaagccaagaacgttgagcccaagatttttcagggattacctgtgccggattttttccgaaccaatagcaatcccaatctaggtaaatccaatccttttcctctatgcttttgtcaaaaccaataatagtaaagccttgatcaagccatttaccatagccgttctgaacaaagacaacatcgccaacaataccatcaaaatggcgaccattaaggactgttggtgataatgttttgacaaattgttgaagtgagttcatcgtgtttctcctaaaattgtaaaataaaggaaaacacaccgcagggagtgtttccctacgggacataaagtaaagcccaacataaattgtcgggcttgggtaaaattactcagattgctcatctgcttttggtttttcttgatagacgatttccccatcaattttaatcattttgatgcggattaagcgacctttaagagacactccagtatcgccttttttgtgatatttactgtcacttgaataagtgaaagtatcgaaccacaaatcagccattacaaatgatacaagcacttttttctcttcagagaccgctttttggcattttttgatgagtgtttcggtttctttaccgactacattcatatcaaaatatctgtactctggtgagtcagattcgccaacaagagctgcaacacgacaagcataaaaaggatttccttttttatgctctactaaacgaatatcgtttaaatagccaatgccggtagtatgtagattgaagtaatttttttgagtagaagtttgagttgtcatagtttgtttctccaaatgtaaaaaagcggagaaacatccttacccaayacgggaaaaatgttccccgcaaggtggaagtaaaatggaatctcaatgaatattcactgaaatgatagggattgagttggcattcctgcaaatttacagagttccctttcagaatgctgggagacattttggcaataactcaactacctctaaggatagccgtcgcttctcaggagttatgcgacttattaagtgctgttatatacagcgtcttaaattgaggataatttagccatattgaatcataaagttaattgagaattgaattttgattttagagaattggaaatgacaacaccgttgataaatcacttaccaacggtgttgtacttttgaagaataaatgaaatttaagttagaccaatataagttactatattgaaaatagcagcaccttcgtgacaatgttgatattttcgttcgtaatttacccgattaccttgtggtctttaatcggcatatctgtggcatcatcgaggacacaaacggcaccctttattcacctgtgggctcaggctcagaatagttagcagtaattgcaacgtcataatccccccaatcgggtaatattatgacgttgcaatcacgatttagacaattacaacagactaatgtggctggcattatccatttaatgtttagttggcattcccacaaagtggagttccctctcagaatgctgggagacattttggctggtgtagattgataaccgacaatctacaaaacgggttctttgttccttgataataccataatctacttgaatttataactggcttcttaatttattcagttgatcgagtacatttaaattactacttttcttagcagatttatttgaagctgattttacctttttatcagcctctttatgttggcaatctggataaccagtacatccccagaatgttcccttagcgtgattgatttttctcattggcttaccacattctgaacattttcggatttcaatattcccaagtgacattccctgttgcatacaactgccgataagttgttttacaaatgcttcttgcttttgcataaatgcatcaagtgtcatactaccttcggcaatctgattgagggcttgttcccataatgccgttaaaccgggatttttcagtaagtccggcaaactatcaattaaggcaacggcttctgctgaggcaaccagtgattttttcttcttaaggagaaatcctttgtcaattaggccttgaattaatccggcacgggttgcttctgtgcctaaaccttccgtttcacgtaagcgttgtttgagtcttgggtcagtcacaaagcgagcggcatttttcattgcatcgagtaatgtcccctctgtatagtgtgcgggaggtttagtttgcaatgttcggacttcagaatgagtgacattgcattgctgatttttagtcaatacaggtaatccttgtttctcatcatcattaccagtttcctcatccacatttttgccaaacaagatacgccagccttgagcaacgatgacatttccccgagcaaccagagtgtgcccactagattgcagagtggcaacggttttatccatttccaagtgcggtaagaattgagcaagatatcggcggcgaatgagatcatagaccttcatttcctcctcactcaatttacttaaatcagcttttttaatggttgggataataccgtggtgagcggtaatttttttatcgtcccacgcccgacttttttgtcgcaaatttaatttaggcaagagagtttgtagccctgaatcagaggcaactaatgagcggattacgttaggaacatcagaaaattgtgattctggcagataaccacagtctgtacggggataagtcgtgattttatgctcttcgtaaagggattgtgcgatatccaacacctgctgagccccaaagccaaacaagcggttacattcgccttgtaaatcacttaatgcgtagagtaacggtggagattttttctctcgtttagtttcaaccgtcaccactttggctaagcctgtttgtttaatttgagcttcggcttgttgtatgacacgactatcaaggcaaagtccggactcatccaaatactgttcaggtactgcaagcccggcaacgaaagtttcaccagaggttgttgtcagctgaaccgctaacgcataatgagatttaggcacgaaattagcaatttctctatctcgattaaccacaagagttaatgttggactttgtactcgaccaacgctcaatggcttaccggaatagccttttgcttgagccattaaggtaaataaacgggagaagttcattccaatcaaccagtccgagcggctacgtcccataccggcgtagtaaagagcctcggtttctttacctgatttgagtgtttgaagagcctttcgaatactggcatcatccagagctgatagccagcaacgttggatttgacctcggtatccagctaaatctaacagctcacgagcaatcatctcaccttctcgatcagcatcggtcgcaatgaccacggaggttgcttttttgataagccctattacaacagaatattgcttcttagactcttttttcggtgtcattttccactgagcaggaataatgggtaatgtttcaaatgcccagcgtttccacgcttcatcataatcttccggctgatattgctcaacgagatgcccgaacccccaagtgacaataatagatttatccgcagtcgccagcaagccttcaccttttgaagtagcacccaatacgccggcaagatctcgagcttgagatggcttttcacaaataaataatttcatattatttcctaaaatgaatacagataggcaaatagtaatgtgctgattaaatagcattcaacgacttattgtctcgtaggatgtaataatttgagaaataaggacataaaaaatcccagtgtttccactgggaagaggttctaggagcaatatgagttattattttaatgtattaagtaaacgctgttttgcactatcgagccatctagcactaccagttgctttccattcaacattcacctgatttttactgcctttttcaatgataacttccaagtagttttcacctaagtgtaccccatcagtatctacatcagattcaaaatagccggaaacatggtaaaaagtaccttgtaccgtatgataaactttacgggagtcactatcagcattcgttgggcggaagccaaattcccgacgaactttcaggaatacatcatcaatattccgcttcaactgcaatgtgccggaatcttgataaacgtacttaccatttcgggttttagtataaacttgtcgcccattatgctgttcaacagagccgtctttagagccatagagcgtctgattcatttgcccggcccaatccccaaccttatcgttaattgctgagagttcagcacagcctgaaattagcattgtagaaacaagaaataaactatatttgatgtaacgcatagaattctccttacaagcgggttatctgcgttcattttttgcaaaagtgcggttaaaatctacttaaaactcttttacttacaaagagaaaaaatattatagctttctgtcacacagtagaccatttagatcgggtctgcttagttgtgagattgttaatatcgcagagataagttctaggcaacgttcacagctatggaaaatatgagtttgagatgacatatgggatatacgcacattttcccagtcatctgggtatacacatccgtgaatttcagtcaagtattgcttgatatgctcttctgtggcttgttcaacccagagctctagctcagtttgatactggtgtaatattttccatcgagttggagggaaattcatatatttatcctctatcaaagttatttttgcaattatttcatcaatgaagagagttaagaagtatttttattactcactatatggagagatatgttatgtggaaaaaaattaggattgattttactgatacagtgaaatgtcaattttgcagtagaatgattacatcaggcaaagctattgttgttcaaaatgaacttggcaatatctctttttcaggaccgtcttgtgctcaaaataagaacggtcagaatgtagtcaatcctaaagagaaaatagttgatatcacaaagggatgtttacttcatgagccaacaacaaatgataaaacggataagcaagtagatgttgagcaagataatttcacatccatacacgatgacgaagtacataattatttggacaataatgctgttaatgcatacctgaccttaagatttgaaaaactatcgcatttaacctcgattataaaatctcaaaagttaaatgaaatctatcataactatgaacttacagggcaaatatctcaaaaagatgaaagttacataagagtgattatgtatggtgaggcatatcctttgtatacataccaaaacttacaagctgtttatgctgctgaatattggcttcaatcatttattcagcataatccagagaatgacttaaattttatacaagacacattaaatcagctcagaagaaagctaacattaactgaaaaacagattatgggcataaataattggtttaagaattctgatggaaaaatggtgaaattaaagacaaatgcttttgtaagagggaaatagttaacataattgtggtggccacttattttgttacgtaggcccgacgtaagactggttttaaaagactctttcctattatttgcttgcttattttgacaaattcaagttatatgtaattcaaaacggttgtttctatatcacttaggaatgtaaattataaaattcttttaaatcaattaattaaatattaagtttcccagattgaagtatgagtacgtaaaaataaagtataaaaagactaaatttcagattttatttttacacaatgtacttactataaaataccaaacagataatatttgtccataaattcattgagttgattatgccatttttacacttattgactatagcgttttgcctaatcatctgtctgattccagttttacccttttcccaatatctttcaatttcgataaatcttccactaatcttgctacatattcaagaaaaagtgcgatcgtttttcaaaggattttatgaaaacgaccgctgtaagaaagaatttttatttacgactttttcaggtatctgaaaactatttcgcttctgaaaaattcaaaattgcttcaggcaaacgcaagccgacaatttcaatggcttctaattcttggcggaattgcgccaattcttcttcggtaaatttcacatcgtctgcgcctaaattatccaacaaatgacgggctttgctcgtcccaggaattggcgcgataaacgctttctgtgccattagccaggccaaagaaagctgtgcaggcgtacaaagtttgcgttttgcccatttttgcacaagctggattaacttcacattttgttgcatcgcttcgggtgtaaagcgtgggataataccacgcaaatctttgcttggatcagcctcaaaacggctgttctcgtccacataaccagccaatgctcccattgccagcggcgaccaaggcacaaacccaatccctaattcttcacaaacgagaatgacatctttttcacgaccacggaaaaacaacgagtattcgctttgtacggcggttaaaggctgaatagcgtgtgccttgcgaatggttttctcgcctgcttccgacaagccccaattcaaaactttgccttgtttcattaaatctttaatagcgccagccacctcttcaatcggcacattgggatcaacacggtgttgatagagtaagtcaatacggtcggtttgtaagcgttttatcgtaccgactattactgaatggcgtggttgggtagatatcgcatcaattgcatcactattattagctacctttcctatttttattattttactcatggaattaaaagttattcataaaaatctcgtggatagtgcaaaaattaaattacatgcggtttatcttgtgattttcttatttgtgagtcactttgctatgatctttggcatggcagatcctatttcagcaggctatcaacccactacaccagcaatgactcattcaatgcaaatggatgctaaacaaataacagaaatgcacaaccaaatgatgacgggcgaaataacgcctgaagaaatgatgaagatgcatcaagaaatgaaccctaatatgaatatgccgaatactcaaggtggtcattcagaacatcataaataataattctgatcacattttaaaaaataatagtggatggtacgttggcatatctctactacaagcagtaggattttgagaaaaattttcaaatgatagaattttttcagattacttgaccttaaccctaggttaagctttaaaatgatgtccattcaatctcaataaaaaataaggacatcttatgaaattacataaattcacccgctcattgttgcttttaagtttaggcataaccgcttttgctcaagcacaaacactttctatggaagtgtggaaaagcccgacttgtggctgttgtaatgaatggatcagctatatgcagaaaaacggttttgaggttaaagtcaacgaaacaggcaattatgatgctcataagcgctttaacattaaatatgaacatgcttcttgccacacagccgtgattgatggctatgtgattgaaggacatgtacctgctgaggatatcaaacgtttactcgcagaaaaacccgatgcaataggcttgtctgcaccgggaatgccaattggttcaccaggtatggacggtgaagcatacggcggacgcaaagatccttatgatgttgttttgattaagaaaaacggtgaaagtgaagtgtttaaatcctataaccaataggggggggggaaagaatgaaacgtcgagattttttacgttatggaattggaattagcttagccagtagctcgctttatagcctcgcgaatatgatgaaccacgcacaacatggcaatatggcgatgatgcattcagtacctactggcctaatgccaactgaggcaatgccttcaggtttatcgcttaatgggatattaccaaaacttgctaatcaatcgactcaagctggactgttcaaagccactttaaaagcagagccaattaaaattcgcctcgcagacaataaagaaacggaattttgggcttataacggacaactaccagggccacaaattgaagtatttgaaggagataccgtagaaattgaatttatcaatcacctaccacaaccctcaacagtacattggcacggcttagatgtaccaaatgaggcggatggtaacccgatggatatggttgaaccgcaagggaaaaaagtctatcgctttacgctacctcaaggcagtgctgggacatattggtaccaccctcatccacatgaccatgtttccgaacaagtctataaaggcttagcaggcactttcgttgttaaagcgaaaaatgatccgcttgcacaccttcctgaacaacattgggtgatttccgatctgcgtttaaatgccgatggcaccattccagcaaacacgatgttagattggataaacggtcgtgagggtgaatttgtgttaatcaacggtcaatatcagccccagattcaagtgaaaacgaatgaacgaatccgtctttggaatgccactagcgctcgttattttcgtttaaacattccaggggtgaaatggattgtggtgggtaccgaaggtggtttacttgaaaaacctcgctcgcctgttgatgaactgctacttacaccagccgaacgcgttgaagtgattatggtgggtgaaacgcaaggaacagtcaatttacaaagcggttattatgatcgccgtaagatgatggttcaagaacagcctaaagatctcactttagccacaattcaggtgaaatcagaacctgttcagttacctgaaagcttaaggtccttgcctaactgggatgagccaaagcaggttcgccaaattcgctttagtgaaaaaatgatgaaccatacgaatatgccaatgatgaatcacggtacacatcacgctactacaacactaacggacaaccctattccaccaatgatgaatggtatgttcttaatcaacggtcaaacctttgatatgaaccgtattgattttgttaccaaattgaatgaagtggaacagtgggaaatcttcaatgaaagccatatggatcatccattccatttacacggcactcaatttgaagtaattcaacatacgttaaacggtaaaacctttaagccagaaggcagagcgttaaaagatgtggttaatttacgcccttatgaaaaagtgattattcgctttaagcaaggacatactgggttgaaaatgtaccattgccatattttagaacatgaaaatctcggtatgatggggatgtttaaagtggaatagtggtatctaactataaaaatagagggatttcgtcataaaaaatctgcaccttaatcagttggtttttagtccaacttttggggtgcagatcagacgctcactttgtcgccgatttgaaattcgccagcgtcatcgcccactgccacgaccacgcctgcccctgcataacccaaagtcgcagggaacacagggtcaatcacatacgccccttcccgatacatcatctcggcacggtttagtcccaatgcacggcacggtttttaaacattttcattatagttttccttatcaaaatgggatttggcaaacattgggcaaacctaagcccgcccaatgtttttagttaatcaattacttgcaatcacaatcgccacaagtgcagttttgacaaatgcacagctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacggcacggtttttaaacattttcattatagttttccttatcaaaatgggatttggcaaacattgggcaaacctaagcccgcccaatgtttttagttaatcaattacttgcaatcacaatcgccacaagtgcagttttgacaaatgcacagctcgccattttggcagttgcattttggattgcaattttgccctgtgcaagattggcaaccgcagtgggcgtttgggtttttgatgatgtcgttcataacaattctccaaattaaaggttgattatcaaaacaaaaaccgtttttaaacccattaataaaaaaatgccatttaaaacggtcacttttgcacaagcaacaaccaatgatggtcaatccttattagcggttaatgacttatttattggccctaaaagccacacttccgcacagtatattttgcaatggaatggcgctgaagaagtgcaatcttcatcaggcattattgtatcaacaggattgggatcaacggggtggtttcaatctattcttgctggtgcgatggcaattacaggagaagcttcgcaccctctattacaaggctttagctggagtgatcgaaagctacaatttagtgtaagagagccatttccaagtagaacaacaggtgttgcactgacttttggcactattgagcctgactcaccactgcaattaggatctttgatgccagagaatggcgtaattttctctgatggcatcgaagatgactatttacaatttaatgcaggttgtattgctcacattggtatcgctgacatacaagggcaactaattagccaaaaagggcgtcagcgaatttagatttatttagcgctctttaatactgtttcaagtccagagatcatcacatcaaggacaaacaaaaatgcagcatcaccattatcactatccataattgcaacggcttgggttaataatggcggataggcaacagtatccgtctctactttttcacgctctttttggctttcttgatgctcttgagtttccagtacggagcctaatgtaaaatgcgcaatagagcttaatgcatacacggcttgagatagactaaacccagcatcacacaaaaactgtagttgctgttctgatgtctcaaattgactttcagaggggcgtgttcccgcatgaattttgccaccatcacgatacattaataaggcttggcggaagcttttcgcgttatttcgcaaaaagtcctgccatgtttcattcggcaatggcaaaacatgatgatggtgcttttgcaaaatagtttctgctaatgcatctaacaaagcgcgtttattttttacatgccaatacaatgtgggttgttccacacctattttttgcgccagcttacgcgttgttaatccttcaataccaacttcattaagtaaaatcaacgcattatcaataacttgttctttatctagctttgccattacctacctcaaaataaaatagccttgacaatctatcactgatagagatatattacacccactctatcactgatagatttttaggatctcaatgaataaatcaattattattatactgctgatcaccgtattagatgccattggtatcgggcttatcatgccagtactccctactctattaaatgaatttgtcagtgaaaattcactggcaacccattacggtgtgctattagcgctctatgctaccatgcaggttatttttgctcctattctaggacgactgtctgataaatacggcagaaaacccatcttgctgttttcccttttaggcgcggcactcgactatcttttaatggcattctcaaccacactttggatgctctatattgggcgcatcattgcggggatcacaggcgcaacaggtgccgtatgtgcatcagcgatgagtgatgtgactcccgctaaaaatcgaactcgctattttggtttcttaggtggtgcttttggtgttggccttattatcggcccaatgctagggggattattaggtgatatcagtgctcatatgccatttatttttgccgctatttcacactcgatattattaatactctctttgctctttttccgagaaacacaaaaaagagaagcgcttgttgccaataggacacctgaaaaccaaactgcctcaaatacagtcactgttttttttaagaaaagcctctacttttggttagcaacctattttattatccagcttatcgggcaaattcctgccaccatctgggtgctgtttacacaatatcgttttgattggaacacaacttctatcggtatgtctttggcggttctgggtgtattaaatattttctttcaggcgattgtcgctgggaaattggcacaaaaatggggcgaaaaaaccaccattatgatcagtatgtctattgatatgatgggctgtttattattagcgtggataggccacgtttgggtcatcttaccagcattaatttgcttagcggcaggaggtatggggcaacccgcattacaaggttatttatcaaaatctgtcgatgataatgcgcaagggaaattacaaggtactctggtgagcctaaccaatattaccgggatcattggtccccttttatttgcctttatttatagttatagcgtcgcttattgggatggtctgttatggctgatgggggcaatactttatgctatgttgcttattaccgcttattttcaccaaagaaaaaccacacctaaagctgttatttcaaccccttaatactagaaattataaagatcataaaagtcctgtccgctcttaataacgttgataggactttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatatcatatataaatactatcaaattaaagatgttgtgtcgaaattaatgtaaaaaaagagaacccttttaaaataaagggttctctatatttatatgggttttattttacagttttaaattatatgtaactcagaacggaatatcatcatcaaagttatccattggtaaatcttgtggatgtgttgcttttggagattggctcatagcttgatagttagattgttgtccatctacgctatttgtagcattacggctatctaacatttgtaatagttcaccttggatttcggttgtataacgctcttgcccgttttggtcttgccacttacgtgtccgtaattttccttcgatataaattttagagcctttacgtaggtactgaccacaaatttcagcataacggcgataaaaaacgatacgatgccattcagtgacttctcgacgttctccggtatttttatccgtccaactttcagaagttgccacactaatattagcaactgcttcaccattaggcatagtccgcatttcaggatcgttgccaagattaccgacaataatcactttattgattcctgccatcgtatttactccttcaataaattaagttagttctattaaacttgattcagcctaagaaaaaagtatttaattaaaatttggttagagtgaatttttcatttttacgtgtgcaatcacttattcctccgttgtaaaggctttttcttcgtgaaggtaaggggcttgtacccttacctttaaaaggccttttaatgcaggatttacaaactgcactttttcaggkattacaaacttgaatatgtcctaattaacggactgtttgttttaccacgtcagcccaccgtggttggcgtttacacacaaccaatataggagttgttatatataaatttactacgaatttaagtctgatttcgcaacggcattatctacctctttcaacttttcagcacaatctgccaactgtcgcaaaatatgattaaacaccgaaatctgcatattaatcaaaatcctgtctttttctactgcgacaacttttttcctcacctccactgggacagacttatcatctacaatcggctgccaaactgtgccaccggttctggcattttgcatactacgccagcgtaaaaatgtaccgcctgaggatgaggccttatccttaatcatataaacagccaaaggtgaaagatcctgccgcacagactgcaccatactatcctgtgcagccataaaataagcccgagcttgagtgaactgttcttgcaaaagttcatagtctgagccagtgtcaaaatggctaaatagctgtttcagagaagtattcagcccagaatctttgactaattgccgataaatttcatcagagatgaggttcatatcactccttatttttgagattcatttgtctgtgccgtgatatgggtttctacggattgctcttcttcaacagtagtgttttgcttgatgaagggagcaaactcagcacgatgctcaccggtaagtacagcatctgagagtgtatagcccattcgttttatcgcagcttgatagcgagcattcttttcttgatagtcccgacgagtgattcctgaactcttataacgctcaacgatcccaaaacatttccggattaaccttgcaccagcttcaatccaatcttgagcttctgcacgattgataatcgcaatatgagctgccgtcattactgaacggcaaaggctatcaaaatcaccaagtaagtagagtaattgataccctagctgtgaattaacataaatcgggtaagaaatcggggaaatattggcacagcgttcaatagaaattccctccggcaacattttggcgtagagcgtgacaatgtcgttggtgagcttttggatttccttccgataattgatcacactttcttcaaattgaatcagataatcgtcagcataaggatcatcttctgatgcagcccgttgaatttgggttagcattgcaaagcaatttggtacgctgataatggaggattgagttactttgccttcctcattacgaatcattggtcgccccacccataatttatgggcatattgggtatgtaacgtaaaagtgatctcactacgaagtggaccaagttgaggatctaattgagtggtcatatatgctccttgtttatttgattattttttagtctttggaaaggggctttccattgtctgttttttaatctttgcagacactgcctacgctgtttattttttatccattgtgtacctggtacacactgattatttttcactcactattaagccccttaacagtgattgttttttaatcttattgtaaaagtaattcagctctaaacttctgcatacgactagccatttgctctctgtctgctgaagttaagaccggtttctcagtaggctgctcagtcagtttttgtatagaatgagcagaattattgttagcctgattctgtgagggaagattttttcctaattcaaaatagtagggtttaaattcaccctgcttcgcccgctggataagcgtatagagataacctttcggttttttcacatcctgcttttgaataatgcgttgttgtacttccaacaaaatagcttggcataaaccgaggtctaatcccttcattgcctgtgcagtaagtttttgttcaagtgaagttaatgggatttcttgtggccaagtaatttcgctcggttccccagtacagtacttattaatatataaagtacggtactgtacatctgacttccctaatggaagtaagtctaaaatcaatgacttatcttcatttttagccctaactcccttattggaagtctggtttttagaggattttttcctgacttcctcatcaaaatccctaacttccatagtggaagttaggatgttttgttgaattttgcttaattcttgttctgtttgcgatggctgtttatctttcaccagctgctgttgctggtatatctgataacgactttgtaaacagtctaaatgagagacatagtgccatttggttttgtctgttattagactttcaacaatatgatttgccacaccattaataaggctatctttatgtttggtgcatttatctaaaaaagagagatagtcgctatttaattgaattgcatctaaaattggcacaggttcatcatgtaggatataaacattaccttgtacataacctcgctcatcacgcactgtttcacataaagtaagccagcgagtaagacggagtaaatagagtgtttgagtcacgactttttccgataatttagcctccgcataaggtctatcggataacattttgctgagcgtctcataagagggaaataatcctccttgaaaggcttgaacattgcacttaatgagctgccaagcaaactttgctcttggtgtaaggcagggatcttgtaataatcgagtagggactgtttcgtgttggttgccaaaaaatagcaatccatgctctgttggcttattcgtgctgctaaacattgtttctctccaccaggataaaagagtttttctcttgctattctctctcctatggctataatgcacgggacttctgcaaagtccttgtaattcataagatagagatacaagactcaatatcgaatgccccaaagctccaacttcggggcatttattttttacttatgttttgaataccattcggaaaccagtttccaaacaaccgttagattcatattgccttcctcagcaatcagacatagaagctctaatccttcttgtgaatctaggatttccattcgttgtttgtatctttgccaaatttcccaaatatgggtagattcttcatcacttgctgccgcttttcgtcccattttttcttcgataccgagtaattgacggcgagccgagacttcagaggttgataaaccaaaatactggtgcaacatttcaatagaggctccgagcaataatgctcggtcaataatttgtcgctgttgagtattggcttgtgcaatagccagtaatttccaaaaggtttcgtgattaatctccaccttagcaaaagagacaacggagttgctaatatccataatttcatcaatactgagattattgatcgcttttagttgctcctcagaaaatcccatttttagacaaggatggatatttccctctttaatattgagcagggcgttaccaatcaatgcttcatttacggtaatcggcttaatcattttctcctccttgttggcgaatatggcgactgacccgaatgagacggaaaattttgactaaggtaagatcatcaagctcaaacaggaatttggaatctaagacacagctattttcatctttatgttcagcagtctgtaacattgagaggaatgagtagagtgttaaagcagacggtgaaagttcagtatctgccggtttcattgcataagtgtaatccactggttgtttcacaatatgttcaaccagatggtcaatgcccatactttcggcaatatctaaggccagtgagtaggcctctgagcgatattgacgtgcggggtgaatcaaccaaatatcttcaaccggttggcgaccttcacaagcaaaagtcagtccattcgcttcagctcgttgctctcgctgttcttgaatactcattcccggagtgagtccaaagttatgggcaatttgggatagataatcttcttgattatcttggttatcgagcaatgaagagccaagctgagataaatcagtaatagcgttattctgctcatcatcactttcgttatcatcaattacctcatcaataatatgttgagctttttggggagtaacggctttattttcatttttgatgagaggttcagattttgcagtttgttgttcctgtctggtattgatttgatcgactgttttttcaactaaattatcaatttcttgttgtttagccgctatttttttgaatttttgttcatctaagtcaatatccagataaagtgtttcaaaactcactttaccctctaaagcttcaaccattgccgtaatcaattcactttggaattcttttgcttgaaatggtgtagcctcattaaatttggataaattttctgaccagagcgattcaaaagtaacatcagtatcaaattgatgggctgcccatacctcttcagcattattacgaatagctaatagtttatcgatctgtgtatgaccaagaccactaaaaagaacttctggtatatgtggatataagtaattaacacaacgttccattttaagaatgagagcatgagagataatatatccatcattttctaactcagaagataactctctcgaagaaagagacttacctaattttttctcgtaatactccttcgcctgcaaaatccccaatgctttttcaataaatgacaaatccgcacgggtatcattttcaatcaaatgcccgataagtaaattgagttcagcttcgacactgtcggcagtatcaccttgccaaggtttatattgacaactgatggaccaaaattttggatctttggtctcggtaaagagctccttgagtgcctgaatacgagtattaccaccgtcagcgataatatagaaatcttctcccggacgacgggtgatattcggcttatgatctaaccctcgacgacgaatagactctttgatcatctcaaagttagggttacgggttttccgagggttatgctcatacggacgcaacttatccagcgttactgtaatatattcaacatcgctactgtaatgcgttggtgtggctgtttggtaggatggagccgtatttgaaataggtgaaacatttaatccttttgctatcgctgccagtcttttttcatcttttgtcataatctatcctaatgcgttgtgtttgttctgttttcaaatagggcaaattcacttctgaaattcgtcattacggaagtaagtggtccgtttctttgcttgccgataatgatttcagcagtgcctttaaacggagaatccgcatcataaacttcatctcggtagatgaataaaatgacatcggcatcttgctcaagtgagccggattcccgtaaatcagagttgatcgggcgtttattggcacgttgttccacagaccggttcagctgagagagggcataaaccggacaatccatctcttttgccagtaatttgagtgaacgagagatgttggcaatttctaaattgcgattttcataacgttgcgaggtttgcattaactgaatgtaatcaatgaaaatagctgccggtttgccatatttacgagcattttgtcgaactttagtgcgtaatttttgaggcgtgagactaccttcatcatcaataactaaacgatttttccaatgttctaggatatagcccattgctgaggttagttttgaccattcctcatcatccaaactgtctgcctgtctaatattttgcaatcccactctggcacgcatagctagaaaacgttgtaaaatctgatctgccggcatttccatgctgtgatagaacacaggagccgactcgaattttttaagtgtatggtaagcgatagtttgagaaaatgcggtttttcccatagaagggcgggcaccaatcacgattaaatcgcctggctgtccacctgttgtcgcttcgtcaataccttgaataccagttggagtacctgtcacaggatctccatttttagccgagagttccatacgagagagcatattggcaaaaatatcacttaaatctgctgcagattttgtattatctgataggctaaactcagtaatttttttctcaatgtcatcaacaacagcttcaaacttatctggcgttttcgcactctgtgtctgatcaacaataaactgccccagttttaaaagctgtcgctgtttactatataagagaacgatatccgtataagcgtggatattagctgtagatggagtgtttttgactatttctgcaagataagcaaatccgcccaaatcctcgatcacttttttctgggtaaggtattgatccaatgtcaatatatctgctggtttaccggcttcaatcaattcggaaatatgcttaaacagtagacggtgagtaaaattataaaaatccccctcattgattttgctactcacttcatcaaagagttcattatccaagagtaatccaccgattactgaaaattcagcctctatagaatgcggctgtacaagtgatttatttaagctagacatacattctccctctatgctgagaagtgagagtttgcaaactgtggcatcagtaacgcacaaagctgactgatcgtttcatattcagcttggctctgacgatagaccggttttgaaaaagttgccgcttcacgatatgccacgcggtcaggtaccgaaaattccagcaatgttttgttttcatcaaactcattttggaagagagtatgaaggtagtcggaaaccaatttgacatctttagtgtgatcaacacagttaatcatcgctttcagcggtggtagggtaaagccaaatgccgtaaaggtttcgaggtcttgatacattccaatcgtgccacgaataaactccttagcagataaaatgtggggaagaataggacagaataaaacatctgctgccaatacagacatatcgacagtaatatctctggtaccacgagtgtcaataatgatgacatcgtaaccttcaattttctggagcagtaaactaaaacgtaatgcaccgtcaggtgaatctctcagcattgggctgattttatttgacgggtcattagactggatcaagtcaagatttgggatagtcgttctagaaataatgtgggtaggatctacatctttaaaatgcagaaattcgtaagttccaccgggagcttgatattccaactcataataagagcttaatgtgggttgggtatcggtatcaataagaagggttcttagaccgtgttctgcacagaatgcaccaatgttagcagcattcgtactcttggcagagccacctttagttgaagcaatagtaatggtaaaaggtttgtttgtaccgttttgtaatggtttcataatttactctcttaacaagggttaaggagtattggccattaatacggtgtatttgaattgattatttgaaagagagaaactacaagtgtgattcaaatggtgcctgaggtcggactcgaaccgacacggttattcaccaacggattttgaatccgtcatgtctaccaatttcatcactcaggctaagagtgctttttattcaatcgcctgtatgtcctatcagtttacgcataagattttgaatccgctacgtctaccaatttcgtcacactggctgtgtgctttattgctcgacattatacgtttataaacttaccttgcaagcagtaatttaatattttggtttatttgttttaattttcaacaaagttacctcaaccgcactttacaaaaatattttatagtaaagtgcggttgtttttttactctctttttctattaagaagccaccaaatgagaataataaaaagtaggcttggaatgagagctgaaaatgcaaccggtatatcatacagaaggcttaatcgcccaaaaatttcattgatgacgtaaaagagaaaaccaaagaaaataccggttaaaattcttgcaccagctgtaacattgcgtaaagatccgaaaataaaagaaagtgccaacaacatcatcaccgcaacagagaccggttgaaagactttttgccaaaaagtaagttcaaaacgtttagcatcttgtcccgtttctttcatgaatttaatatagttgtataatccagtcatagacaacgacgttggacgcaaagaagctatccccagcttatcgggtgttaacgttgtactccaattatctttcaagcgattaatcgttttaatttcatcagcaaaaatttgtgattgattaattccgcttaatttccatttgccatgttcaaaacttgcttggttcgcatgtgtaacttgtttcaattgacgcttatcatcaaaactataaatataaatatcattcaacctaatatcattagtaatacgaccaacatagataaaatcattaccatcttttgcccaaatactattttttactgaaagcatggagcctccggaaattgcttttgcacgcatatctctggcaaagtgttccgtctgtggaataccccattcgccaataatcattgtgataagcatcaatggcaatgcggttttcatcacggctaaaccgattctaaagcgagaaaatccagcagattgaatcacaataagttcactacgacttgcaaggttaccaagtgcaataagtgatcctaataatgcagccataggaaaaaatgtttctatatcttttggcatagttaataaagtaaacagtgttgcctgaataacatcgtaagttccttttccaatactacgaaattgttcaacaaatttaataatcgctgataaacccaccaacatcagcaatgtcgccaaaatagcacctaaaatattttttccaatatagcggtctaaggtattcatcatcattattcctgattaccttttacttgaattaaagttaaataaataacgtattttatacataaaaacactattccaactgttcaataaaacagctaaaaataaaaagaaaatactgactaacggcataaaaatatgtgcttcaattttaccggaagcccccgctgattttaatgaactttgtaacaagaaataaattaaatacaataaaagtgcgggcaaaatcttagcaaaccgcccttgtctcggattgactcggctgagcggtactgcaataagtgccataatcggaacagcaaaaattaaggtcaaacgccaatgcaattccgccttagctgcaggtgatttagaattaattaattcctttaggcttaaaatttccgtttcagatgtatccttatctgttgtcttataatctaaataggcttgatactggtcaaaatgcgtaatacgaaagtcaggtaaaagtgcggttccttcaactcgctgactattttctagactaagaacttgatcgccattgggtaacgccttcaactgaccggtttcagctaccgttacggaaggcttctgattttttttattttccatttggaaaacataaatatcttgaatttgattgttttttatttcattgataaatagcacaacatcagtatttccgacattaacaaattgtcccgacgctaaagcccccattgttggatttgcttttgcatcatcaataagttgaatttgtttttgcattgcccaaggggacagataaaacacattataggttgccaatcctgctgtcaataaagataaaattaacgcaacaccaacaagaatacgctgaccaacaccacaagcccgcatgacggtaatttcgctttctgcatataaacgtccaaatgtcagcaatatagcaataaataagcaaaggggaaatataagttgtgccatcgtcggcatacccaagctaagcaaagcaaaaaccaaatcagccggaattttaccaacagatgcagaacctaatacacgcacaagttgttgactaaaaaaaagcagtaaaagaatagataagattgcaatttggcttctaaaaacttctttggttaaatatcgaattaatatcactgaattacctatatttctcttgcaattttaaaaaaaagcagtaatttacgaaatcacatacatggcgatgtatgataacgtatttttttattgaaaacagtaaattcgtgaggattacatgaaatatagtgcaaaaaataccgcactttctcaaattgacagcaacattattttagccgtatttgagggcggaaaactttctccgacagcaatgcaatttgatcaactcagtcaaggctacctaactcgcttaattcaagtaggtgaagttagcggaaaacagggacaagttcttattttacgggatataccgaattgccaagcacaacgtatttttatcgtagggtgcggtaaaaaagataaaataacagaacgtcaatataaacagattattcaaaaaacaattcaaacgattcttgagactcaagcaagtgaagttgtgagctttctaaatgaaattgaactaaaaaatcgtgatattcattggaatattcgttttgcaattgaaactattgaagcaagtttttatcaatttgatgctttcaaaactaaaaaaggcgacgaaaattcagtattaaatgaatttatttttgatgttcaaaccgaattacaacaagatgcactactggcgattacttacgcacaagctattgcattaggagtcaaacatgcaaaagatattgccaattgcccgcctaatatttgcaacccaacttatcttgccgaacaagcacaatccctcgctaaacactcaaacttgattaacgtgcaagttttgggtgaaaaagaaatggcagaattgaacatgttctcgtatttagctgtttcgcaaggaagtgctaacgaagcaaaaatgtcggtgattgaatatcgtaatcaccccaataaaaatgccaaacctattgttttagttggaaaaggtttaacctttgatgccggcggtatttcattaaaacccgctgatagcatggacgagatgaaatatgatatgtgcggtgcggcttctgtatttggtgttatgtacgctctggcaacattacaattacccttaaatgtaattggtgtattggctggttgtgagaatttgccggacggaaattcatatcgaccgggagatattttaaccactatgtcaggattaaccgtcgaagttttaaatactgatgcggaaggacgtttagttttatgtgacgcactcacttatgttgagcggtttaaccctgagttggtcattgatgtagcaacactaacaggtgcttgtgtagtggcattaggtcaacataacagtggcttaatcgcaacagatgaaaaacttgctgaaaaattattaaatgcggcagaagaaacgaccgataaagcttggcgtttacctttaagcgaagagtatcaggaacagttaaaatctaattttgctgatttagctaatattggtggacgttggggtggagccattaccgccggtgcatttttagctaactttacgaaaaattatccttgggctcatttagatattgcaggaactgcctggttacaaggtacaaacaaaggtgcaacgggacgaccggtaagtttactaacgcaattcttaattaatcaatctaaataactgcaaaagtgagagtttctcttttagaatatgagtatcaaaattcaatctaaacaaaaggagactctcattttttattccactgatccatttggctgagatttccaccgcacttaccttctatctatcgccatcattacttaactaatacaactaatccagaattttattaaactttgatctataaaatttcagtataaaagatgattttatgaatgaaatgagctaaagtagccgagttttgtagcaaggatgatttttaaggatacctcatgaaacaatctctgcgtcataaaaagataattgaattaataaaacagaaaggctatttgagtacagaggaattggttaacattcttaacgttagccctcaaactattaggcgagatttaaatgaattggctgaaaataatctgattacacgtcatcacggtggagctacttcactttcaacatcagagaacagtgattatagtgaacgtcaacatttcttctcgtctgaaaaacggcgtattggtcaagaggtggcaaaaattattcctaacggttcatctttattcattgatattggtacaacaccggaagctgttgctaaagcattattggatcatcaaaacttaagaattgttacaaataatcttaacgcagcctatattttgatgcaaaacaaaacatttgatattacgatggctagcggatctttgcgtcaagatggtggtattattggtgaagcgacaattgcatttatcggacaattccgtttggatttcggaatattaggtatcagcagtattgatttggacggttctttattggattacgattatcatgaagtgcaagtgaaacgtgcaattatggaaagctcaagaaatactattttagtaacagatcattccaaatttactcgccgagcaatggtatatttaggttcgttaacagaagtagactatttgtttacagacaccacaccacctgactccatgcttagccttattaattcaagcaatgtaaaactgcatatttgtcaatagaaattttatcaatagagatgtgtagaagattttatcttctacacaataatcaatttaatgccctcgccaataaactgatagggtgtaaacaagaagcacttgttgacatatcaatttgccatttgcaagtttcacattcagtgatgacataatcgaaacaaccttgttcaataacctcaaataaactttttccgatggcctgtgaagtctgatagttttcagatttaaagccatatgttccagcaataccgcaacattgagacggtaaaatagtaacatcaagatccggtatttgtttaagcaatgccaacgtataaggtgcccaccccgctttttctacatggcaggcggtatgataggcaactttaagaggtgtagacttaaagtgcggtatttttccatcaagatatagtcggtaaagatatttggttgcaatattgacatgaggacgaattctcgcattatccatccccaaaatatgatgatattcatcacgtaagttcattgtacaacttgaagatgtaccaataatatccaatgctttttcttgaatcacccgttcaatttgtttaatgttaaactctgcttgttttttagccttttcaggaaaaccgttcaccatgagcggcaaaccgcaacatttttctttttcaagcaaaatcacgccaatatcaatcgaattaagtactttaatgagatctttgccaagttgaggataattataatttacataacaaccgtgataatacactatcttatcccgaaaatagatctgacggtcaagagcatattttttataccattgacggaacgaaccgaatgaatattttggtaaagtgcggtgcttactgaccttaagggttttatctaaaacatatcgggttgcttttaatccagtaatcgcatttacaattggagcaaaaggcgtattcattttacccatgatatccgtattacttaatacagcatcacgtaatttatgtattggtgatttatgttgttggtcaagatatttatttctagcacgaatgataatatcaccaattttaacgtctgacggacaagcaacctcacaacgtttacaattgatacaatattttaatgcttcatcataaagtgcggcactttttaagcgtaaccgttcaccgtccggtcccgcctgtttaggtccgggataaaaaggattttgacgagaaacagggcaaaccacagtacaagcagtacattttatacagctctcaaaactttcatcggtatggtgctgagtaataggaaaagcagcatgttgttttgcattttcaatgagttgttgaatattcatattttgccccttatactcgattttgtgcttcgataatgttatcggcaactgttagtgcagtaacaactgccactccggaaccacaccctagttccaatgcattgtatccgccaataacatttccagcagcatataaatttttaataatctgaccgctcttttttaattggcaacggctgttaattgcaacgcccgcagactgataaggctgaggtgaagaaaaacgccgagcagtccaagtgagtctgttttgtatatcaatcattgaattgccaatcatgtccacgtcaaatataggttcaagtaaacgatcaaaaacactcaccaaaccattactgaaaaaactgccggaagcaagaacaaaatgttctgcgaaaataccatgttcttgatgtaattgagtgtaaatttgtttaacctgttgatcctcaataacggcacgcaatgctttatcaccatttaaaataaaaccgcccagtttttcaaaatacgtttttaattttttatgttgacgcaatcccactaatgaaggcggtaatgtaggcaattcgtataaatttaatccagtttccaactttaatttattgaaaaagtcttggttatctaaaccgaaacacgccggtaaaaagacggcttccgcacctccggacgcttgctttatttcttgtaccaattcacgaaatgccaaacggtgttcaagtaattgagaaatattgacactgcgaaactcacgagaagttaaacgcaattgatccaactcaggaagatgtaaaagtgcggttgttattgaacaatgtttaaattgcggatgttgtattaaattttcagccaataagtgcggttgaaaatcatgataaccttcaattcccaatacagtaattttttggtatccaaaatgttcatcatgaagatccattgttggaatacaatcagcggacagccaagtgcggtgtaatccgcccaacggtgtaacacgaaaatgattttgcttatagcttcccgtcacattgagattaattttttctattaattgttcaaattgcttggctttttgtaaaacatgttgtttaccaaataaacagtacggatgatttggaagttgttcttcaaggctgtcataaccttgttcaaaagaatttatcttttcaccgtttggtaattggcttaaaagatccattgaacctgatgaaaaattcatggctgattgaccattattaataatcgcacaacatttccctttttgttgaagcataattccgcaagttaaccccgcaagcccgcctccgataatcactacatcaaatttcattgccatctgttccttgctgtgcttgttcagttaaagattgaacactatttaagcctaataaactgtaatatatccaactggaaaattccgcttcacggattgcttcgccccaagcaatcggttcaatacctcgccaacgttcttccataaaagatgataattgcagtgtagattgtctaggtgttgccatatgaaaacgtgccattaatcctgccgcacggcaagcacaaagttcagcctggcaagttcccatgcccacacgtgtacgacgacgtaaatcaacaagattattgacttttaattcttctacagcataacgtacttcaccggcagtcaccgcttcacattcacaaacaagtgtacaatctgaccgctcttttccaatcaaacgagaagcccgttgcccatgacgataacgtgcggaaatttgaagaggtgttggtaacgatatgattttattaatatgaggaacattttgatcagattcagaacctggaagtaattcttgggcagttgtacaaacagtttgtttgccaagttttttactaactaaatcagttgcccattccgccatcaaacgataagtcattaacttacctcccgtaatagtgacaaaaccttcaagaccatcacggcttgcatggtcaagcaatacaataccacgactaacattacgtcctgatggatcatcatcactcgctactagaggacgaacacctgcataggcacgaagtactctagtatgacgtaaactcggtgcaagtttttcgccttctctaaataaaatatccacctcttcgggagtaacaatcatattatcaatttgatcataagggatacgatctgatgtggtgccgataacacagatagtatcgccaggaactaaaatatccgcatcagctggtttgcgacatcgattaattaccaaattattaatgcggtgccccatgacaagtaatgcacctttagcaggaaacatcttgactttgagatcggcatattcagcaatcccctgtccccaaattcctcccgcattaacaataacctgagcaaaaaaacggcgatttattttatttttgtgatcatatacttctgtaccaatcactcttccgccttcacgaatcagttgagtaactgcacaataggtaaaaattttagctccatgctcacgtgcatccaacatattggcagaggttaaacgaaacggatcaattgaaccatcgggaacaacaaccgcacctataagctccgggtttactgaaggctccattattctggcaaggtcaggctcaatcggtactgcttcaatacctgcttttgtacaggattgaataaatatcttttgataattaagatcgtcttcaggtaacgtaatgaaaagccctttggtatcttcaacacaatgacgtgcaatacgttttaagatcttattttctaagatacattcctctgccgattcatgatcattaacagcgtatcttgcaccgctatgcaataaaccatgattacgtcctgttgcacctgtggcaatgtcataacgctctaataatatgcagtcaatcccacgtagtgcacagtctcgtgcaataccggctcctgttgccccaccgccgataataatgacatcagcactgagcggtggaaaatctttagaaaatttttgagacgacattgacataatcatcccccacattgaatgtaaaaaattactattagaaagtgattatataatacgttaaatgttcgttttagaaaataaaatgagtgatttcttatcaaataatgtgattaagatcactttattagtttcgatttgaattttttttgtgtttttttgtgatttacatcacaacataaattaaattagctttttagatttcactttttggttattatatgagtgaacgttcaaaaaagtgcatttatcggtcctaattttttatacataagattggtttgataattgctatattttaatctaactaaactactggagatttattatgtttggtccatttaagcccgcaccgtatattgaggagctatcaaaagatagaatcgatccaacttatagacggttgcgttggcaagtattcatgggaatatttttcggttatgcggcttattatttcgttcgtgctaactttgacctagctcaaaaagggttaattgaagccggtttatacaataaagcggagttgggaattatcggtacgggagcaggtttggcatatggattgtcaaaatttgtgatggcaggtatatctgatcgctcaaatccgaaagttttcttgcctttcggtttattattgtcagggttatgtatgacaatgatgggcttaatgccttgggcaacctccggtattgctgttatgtttgtgatgatattcttaaatggctggtttcagggaatgggatggcctccatgtggtcgtacaatggttcactggtggtctaaatccgaacgtggaacaatcgtttctatttggaactgtgcacataatatcggaggtatggtaccgggattaatggtattgttggcaagtgcgatttatttcagcgagtttggagtacaggcaactgcaaaagatatttggcaacaagcgttatattatccgggtattgccgctatgatttgtgcaattccggtctattttgtgatgaaagatacaccacagtcttgcggattacctgcaattgaaaaatggcgtaatgattatcctgatgactataatgaaaaaacctatgaaaacaatttaacaacaaaagagatctttgttacttatgttctaaaaaacaaattgttgtggtatatcgctattgcaaacgtatttgtgtacctcattcgttatggagtgttgaaatggtcccctgtatatttaggagaagtaaaacattttaatattaagggtactgcttgggcatacactatttatgaattagctgcggtaccgggtacattattatgtggttgggtttccgacaaagtatttaaaggtaaacgtggtttaaccggtttcattttcatgattttgactactattgcagtggtagcattatggatgaacccagcaacaccagaacatgaattagcacagtatgcaggaaaagcgtggtatcaaaatccatatcaattaactgacttcattttaatgacaacagttgggttcttaatttacggaccggtaatgttgatcggattacatgcacttgaacttgcaccgaaaaaagcagcaggcacatcagcaggtttcacagggttattcggttatctcggtggtacagtatccgcttcagccgttgtaggttgggctgcagaatactacggctgggacggtggcttctacgtcatgataaccggtggtattttagccatcctgttaatgtttatcaccatgatagaagaaggtaaacataaagcaaaactagacgatcattacggtaaataatcgttaaaaaggaaagacaggaaactgtccttcctttttctttattaggtttatgtattcaaattttaaccacatttttatcacagattttacttctacttaaggaaaatacaatgaaattagctacccctctttgtgcaattactttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatggacgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggcaaagatattgctttagcaacattaaaagttttgaaaaaatacggttatacgaaaaaagatgacttagtctatttacaaacttttgattttaatgagctaaaacgaattaaaacagaattgttgcctaaactaggtatggatgtaaaacttgttcaattagtggcttattctgattggggtgaaacacaagaaaaaaatgctcaaggcaagtgggttaattacgattatgattggatgtttaaaccggatgcggtagaaaaaattgcaaaatatgctgatggtataggccctggctggtacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataattcgacattaatatctgtcattcttttaaacgaatgacagatttttgttcttgttgtaaatagccatttctccattatcctagcctttcaacctcaaccttcccctacgatatttcgtgcgtaaaagtgcggttattttatccggtgtttttattgcaatagaattagcaatctgtaatgagttatgaatagaatttgcatgggtaatggcaattgccaacgcatctgctgcatcaacctgcggtttatcggaaagttgtaataaccgaaccaccatttcctgtacttgtgatttttcagccgcacctgttccaacgaccgtttgtttaatcgttctaggtgaatattcaaatacgggtaaattttgattgactgcggcaactatcgctgttcctcttgcttgccccaattttagagcagaatcaggatttttcgccataaaaacctgttcaatagcaaattcattgggattgaattgcgtaataatttctgttattccggcataaattcgttttaatctagttggtaaatcatctattgaggtacgaataacaccactgcccaaatattctagcttatgcccaacttgacgaacaacaccatatccggttactcgagatcccggatctattcctaaaataatagacatcctattttccaaaaaataaatgaacctcatttgagatccatttaatatagactaaaaattattttccaagtttaagagattgagctgatgaaacgtttttcatcatgcctctcaactaatttcataaatgttcctgatagaaaaaatgaagctaacttttaaagtaaagcggcaacctcatcacttatctcgccattatgataaacgttttgtacatcatcacaatcttccagcatatcgatcagtcttaacaatttaggtgcggtttctgcatccaaatcaaccattgtggaaggtatcattgttacttcagcattaacaactttaaatccggctacttcaataccgtctttcactaagcctaaatcttcccatgctgtgtaaatttcaacactaccgtcttcttgtacttgaatatcatcagcacccgcttcaatggctgcctctgtcaaggcatcctcgtcagcagactcaactaaaattagcccttttttactaaataaataccctactgagccttctgttcccaaattaccaccgcactttgtaaaacttggtcgtacttgagaaatggtgcggttagcattatcgctgagacactcaaccatcaccgcagtcccgcccggaccatagccctcataaattctagtttccatattggtgccatcaccaccgcctacaccacgctcaatagcacggttgatagtatctcgtgtcatattgttagataaagctttatctactgcggcacgtaaacgagggttagcaccaacatctccgccacctaattttgccgctgttactaattcacgaattaatttagtaaaaattttaccacgttgtgcatcttgtgctgctttacgatgtttaatattggcccacttactatgtcctgccattttatattccttttatgattgtacttttatattcattaatcgcctctgcattgttgggcgatttagtcaatttaattgcgtcctgtaccgaacaccattgataagctgaatgttcacttaaatttattactctttcatcagctaacggcaacaaaaaccaatgctcaatgcagtgagttatatcaggtgcatatttatacctaaaatgcggaaaaatttcaaactctatctgtttatggcaattaaagagcggtaagttttccgcaagaatatctatgccggtttcttccctcacttctcggattgccgtttgaacaggtgtttcacctatttccatcgtaccggttacggattgccaaaattccgaatcgtcttgacgttgcaacattaaaacacggttggttttcttggcataaataacgaccaaaatactgttgggatttttatagttcatttggattaccttcttaaagtcatcatcactcacattaaccaaaataatgttaaatgaaaaaacaacaattgatctgccccaaaatctcttaataaatcaaaatattaaaacatcattaataattaagatagcatttcaaatttcgtatcattgctacatagtaccgacttttttagcaaatttttctacctttttcttttcttctaattctttttgttgttgctctgcacgtttacgacgaatttctttcggatccgccaataatgggcgataaatttcaatacgatcaccttcattcactatatccgttaattttgccgggcgactgaaaatgccgactttattttcacgtaaatcaatttccgtaaattcctgcaaaataccagattggaaaatggccgcttgaatgattgtccccttctcaacttgaagttttttcaaataatatttatgcggtaacgcataagtaatttctatattaatcaagataaacgtcctttgctcgttgtttaaacgcttcgatcattttcgttgtcaattgtgaaaaaatccgcccgaaagcaaaggcaataacagggttggaaaattcaaactccaattgcaacgcaatttcacaactttgctcatcaatttcacgaaaaacccatttaccctgcagatatttgaaaggtccggaagctaactgcatcgtaatctcttggttgggaattaattgatttttagtcgcaaaaacctgtttgataccggctgtgctaatggttaattctccgatcgtttcattgtctatcgactgcaatgctcttgccgcaatgcaatggggtaaaaattgtggataactttcgtaatcattaacaatatcgtacatttgtttagcactataagacactaaagctcgctgatttatacttggcataaaataagatgttgaacaaaaaatgttgcaattatagcggaaaagtgcggtagaaataagagacaaaatagaaaagaatgattcatacaacaagctgttaatgtcgttgctttctaattgagcataaattaattttccgctacaatagcccactatttttagcgaacaaaaataccaatgtcagaaattaaattaattgtgggtttaggtaatccgggcgataaatatgccgatactcgccataatgcaggtgaatggttaattgaacgtttggcaagacgctttaacttcaatctctctgttgaatccaaattttcaggaaaaacggcaagagcggtcattagtagtcaagaaatgcgttttcttgttcctaccacttttatgaatttaagtggcaaagcagtaagtgctttagctaatttttatcgtattccgccggaacaaattttagtgcttcatgatgaattggatttttccccgggcatcgctaaaattaagcaaggcggaggacatggcgggcataacggtttgaaagatattattgctcaactagcgaataataaaaatttctatcgattacgcataggtattggtcatccgggtgataaaaatttagttgcgtcttacgttcttaataagccatctcccacagatcggcaattaattaaccgctctttagaggaggcgacggattgtattgaaatcctcatgaaagagggaataactaaagcaacaaatagactgaatgcttttaaagcataaacaaaattcaccaatctttgggctgaaataactcttctactctactaataaaaaataggaaaatttatgggatttaaatgtggtattgtcggtttacctaatgtaggaaaatccactcttttcaatgcgttaactaaagcaggtatcgaagcggcaaactatccgttttgtactattgaaccgaatacgggcgttgtaccgatgcccgatcctcgtcttgatgcactggcagacattgttaagcctgagcgtatactaccgaccacaatggaatttgtggacattgcgggattagttgccggtgcaagcaaaggtgaaggtttagggaataaatttttggcaaatattcgggaaacggatgctatcggtcatgttgtgcgttgttttgaaaacgatgatattgttcatgtggcaggcaaaattgatccgttagatgatattgaaactatcaacaccgaattagcgttagccgatttagacagttgtgaacgagcaattcaacgtttacaaaagcgtgctaaaggtggcgataaagaggcaaaatttgagttgtcggtcatggaaaaaattctacctgtattggaaaatgcaggtatgatccgttctttggatttagataaagacgaattacatgcaattaaaagctacaacttcttaacgttaaagccaactatgtatattgctaatgtgaatgaagatggctttgaaaataatccatatctcgacaaagtgcgtgagtttgctacaaaagaaggttctgttgtggtaccagtttgtgctgcaattgaagcggaaattgctgaattggatgatgatgaaaaaactgattttttacaagatctcggtattgaagaacccggtttaaatcgtgttattcgtgcaggctatgcgttattaaatttacaaacctacttcaccgccggtgtaaaagaagtgcgagcttggacagtttctgtcggtgcaacagcaccaaaagcagctgccgttattcacacagattttgaaaaaggctttattcgagcagaagtcatcgcttatgatgattttattcaatataagggagaggcaggtgcaaaagaagccggtaaatggcgtttggaaggtaaagattatattgtgcaagatggcgacgtaatgcacttccgttttaatgtttaatattcataactaattttataccgcatttttcgatttgaataataaaagtgcggtattttttagagagaaagatgaaatatcactttatttcccggtgttccattaaagtttttaactgggagacgtttgttgatgttgaagatttagcagatgatcctgcgagaatacaataaccgaatgaatgatctttagtgtggcttgtgtcataataggcatcgttttttcagcaaagtagcggagaatgattacatgagaattttacatactatgttacgtgtgggcgatatggatcgctcgatccacttttatcaacaggtattaggcatgcgtttattgcgtacaagcgaaaacactgaatataaatattctttagcttttttaggctatgatgatgaagaaaactcatctgttattgagctaacttataactggggtgtaagtaaatatgaaatggggactgcttatggtcacattgctattggagttgaagatatttatgccacttgtaaagcggttaaagaagcaggtgggaaaattactcgtgagcctggtccagtaaaaggcggaaaaactgtcatcgcatttgtggaagatcctgatggctataaaattgagtttattgaaaataaaatggcacaagcagggctaggtaatcaataacctcaacaatttttatcctaaaaaatgggctttttatctgcctattttaagtgttacatttatctcattcttataaggcaatatttcgtgaccgcactttcagaacaagcagtggattataatttacttaaaaatcgctttcggggtttttttcccgtcattattgatgtggagacagcaggctttaatgctcaaacagatgccttgctggagctagctgcaatcacactgaaaatggatgaaaacggtctattagtaccagatgaaaaatgccattttcatattcaaccgttcgaaggggctaatattaatcctgaatcactcaaatttaatggtattgatatagacaatccgttgcgtggtgctatatcagaaaatgttgctatgagtgaattgtttaaaatggtgcgtcatgggcaaaaaaaggctgactgtcaacgttcagttatcgtggctcataatgcgacatttgatcaaagttttgttatggcagcggcagaacgtacgaaaataaaacgcaatccgtttcatcctttttcgatatttgataccgcaacgttaagcggttttatgttcggacaaacagtgttggtcaaaggttgtcaggttgccaatatttcttttgatggaaaaaaagcacattctgctttatatgatgcggaacgaacagctgaacttttttgttatatggtaaatcatttaaaaaaactgggcggttttccccatgtggcaataaactcataaaaaacggtgctaacaaagcaccgctcttttgcgttactcattattcaaattactgtacaacaatactccctaaacaaccttgatcagctaacactaaatcagatgaaccgaaaataaaagggaatttagtagaggacgcatgattaaattgcactaaaatttctaccttgccgtcaatccaaagactatctttccatgcaatatccgattgttctaccggctgatcatttatgcttttcatgacaaaacgagcaccttgaattttaaatccgacgggccttgaagaacttagaatccagcgttctatctgccctcttttggtactaatgtctattctattcggttcaaaccgttgttgattaatggttgcattgctcacatcaaaataaaactctctcgttttcatatttttctttgccaataaactaggtgcatcagtatgaaattgccaatgacttggattataaaatactgattgaaagccctctgttcttaactcaacaataacattatcaaccagcatatcagaactgaatattgtacctatcttattcaaaagatttcttttactaccggtaattaaggtagcatttccgccctcacttaagtcaaccaataattcaaccctttcactaggtgcaagagaaacttttttgacaatttttgtttgtggcaaataaccttgttctctggcaatcaagaaaaatgcccgatcatcatcaaatgttaaatcataagaacgagataaagaggcattcaacaaacgtaaacgtaccaatcctttaggtacattcaaataaggtgcttcaacaccattgaccaataaccgctcgcctagaaagtgcggttgattttgaaatacttgctctcccttagaatttaacagtacatcttgcaaaataagtggaatatcatcaacgccatatttttttggcagtttagattgatgagtatctttgtcatttataatccacatgccaactaagccacgatacgtttgatacgctgaattagctaaagtgcaggcatgataaaaacaagttgatgccggttgagtaataggtaaaattggagcccatccttcccctgccttcaatactcgcccaataccaccaattaattcactgtgtgcttgtaaaccttgtatattcatagcaactgcctgcgttaaattattacgataatttaacttcacaaaatcaccttgctcaactcttacggtaggacctaaatgatgcccattaaatccccaaacttccgttagctttttttctatgaatgaagtttgagcagcttgcatcgttaaaaatatcggtcgcccacgttttgcctccaataacggtggaataaataaaggcaaacggctagcagccattactgattgagggatacatgataaagaactggctaaaataccgcttttcaaaaaatcccgtcgagtcaaagatctcatattttaccttgctgcttatacagattgctgttgaatttctgcatcaagctctgcgatgcgttgttgcataatttgatgacaatattcagctaattcccgtacattatcctttgtgtagtttgatgtatctacaggagacatcatttcacaaatcactttaccattgtcccaccgatttaggtcaatgcgattatgggtggttgaacaaacgaccggaacaattggcacaccagcggtaattgccgcataaaaagcccccattttaaaaggtaataatccacgcccacgactacgtgtcccctcaggaaacatccaaactgacaaattatcttcatttatacgatgagcaagttggtttattgtattatgggctttggagcgattttctctgtctaacaaaatatttcccgttgcccaataaagaagaccaaaaaagggaatccaaaccaaacttttcttgcctacactgactgtacgagggcgaaccatagcagaaacagtcaccatatcataattattttggtgattaccaatatagatgcacctaccgatactatcgacattttcaggaaaacgatgttcaacttttaatccaaaaaaaggatataaacgcccaaaccagcgagccatcacacctacattacttggatttttaaaacgaataagtgaataaagagatcctactacacaaattaaaatactacagaagataacaacgatggctcttaataatatcaacataaatatacccctaaaaatttgtatacgccaagtataacgaaaatctaaaaataagtgtagaaaaccataaaaaagtgctaggctagcacaaatattttaggaatcttagtatgaaaaaaacattctttattgcagatttacatttgagtgaaaaccgaccgcatttgaccgaactctttgttcaatttatgcaaacgcaagcactacaagcagaaaaactttatattttaggtgatttatttgatttttggattggtgatgatgaacaatcagcattgatcgaaacagtacaacaacaaatattacaacttactcaaaaaggtatctcttgttattttattcatggaaaccgtgattttttactgggaaaaacctttgccaaaagttgtggaatggaattattaccaacttaccagctcattgatttatacggtgaaaaagtgctgatttgccatggtgatacgctatgtactgatgatcttgcttatcaacaatatcgcaaaaaagtacaacaaaaatggctacaatggttatttcttcgtttgcccttaaaagtgcggttaaacattgcagaaaaaattcgccaaaaaagcaaaacagataaaacacgtaaaagcgttgaaataatggatgtcaacaaagattttgtggaacagattatgcaacaatttcaagtcaaaacccttattcacggacatacgcacaagcagaatattcatcaaaatccaccgcactttactcgcatagttttaggtgattggggagcaacagcttctgttttagaggtttcagccaatgggtttcagtttatctaattcgtcaggcacaaaacctaaacataaagaaaaagagatcaaaatgtgctatttttccatcacaactaaattttttccaatttggctaaatgcgcgattagccatttaataccttgtccctgaaaagcgatttgtaatcgggtattattatcagccccctcaacattaatcactgttccctgaccaaatttttcatgtttcaccttttgtccaactttccaactattatccgataaatcagttttgacgatagaacccactgcacttcggttataagctcgagtcactgtgccacgtaaacgaacttcttgaatacattcttgcggtaattcagcaataaaacgagaaggaatatgtttttcgtctttaccatacaagcggcgaacttccgcataacacaatgtcaatttctgttttgctcgagtaatccctacataagctaaacggcgttcctcttccaaacgtgccaagtcttcacccgaacgaaaacttgggaaaagcccctcttccataccaacaataaatactcttggaaattctaagcctttcgctgaatgcaatgtcatcatttgcacacaaggctggtgagaggctgcttgttcttctcctgcttccaaagaggcatgtgttaaaaacgccactaaatcagacatatcttcagcctcatccggttttataaactctctcgttgcggtaaccaattcctccaaattttcaattcgcacttcccctttgtcccccttttcctgtttatacatatcatataaaccggaatgtttaatcacaaaatcagtttgtacaaataggggcatttctgcggtttcttgttgtaaggaattgattaattcaataaaacgtaacaaaacagttaccgaacggataggaattaaattttcttgaatggcaagctgagttgcttgccataaagtcacttgtctttcacgagttaaattacgcaaaatatctaaagtacgttcaccaatccctcttggcggtgtatttacaacacgttcaaaagccgcatcatcttgtcgattggcaattaaacgcaaatacgctaaagcatctttaatctcttgtcgttcaaaaaatcgcataccgccataaatgcgataaggaattttagctctgagaaatgcctcttctatcacacgagattggctattgctacgatataaaactgcacaatcatcaaccttaccgccgttatccagccaattttgtacctgaccggagacaaacaaagcctcatccaactcgttaaaagccgcataaatccccacaggttctcctttttcacccgcagtccaaagatccttacctaaccgattactattattggaaattaaacggtttgcactttctaaaatgttgccggttgaacgataattttgctctaaacgaataattttcgcttttgcaaaatctttaagaaaacgatgaatattctcaatttgagcaccacgccaaccatagatagattggtcatcatctccgacaatcattacattgccctgcgaaccggctaataatttaatccaagcatattgaattttattagtatcctgaaattcatcgatcaaaacgtgctgaaaacgctgttgataatattgcaaaatatgtggattttttagccacaattcataagctctcaataataattcagcaaaatccactaatcctgcacgatcacaagcatcttgataaattttatagatcttgatccactctcgctcttgacgatcattattatcttcaatctgattagggcgtaatccttcttcttttttattattgatataccaacaagcttgtttatagggaaaggttttttcatcatattgatgcaatttcatcaaacgcttaactaagcgaagttgatcttcactgtctaaaatttgaaaatcctgtggcaatccggcatctgcgtaatgggatcgcaataagcgattggcaatactgtgaaaagtgccaatccacataccgaatacacgttgatgggaataacgagctaaagttgcctcaatacgatgacgcatttccgtcgctgctttattggtaaaagttaccgccataatacttgattcaggtattttttctaccgcacttaaccaagcaatacgatacgttaatactcgagtttttccgcttccagcaccagcaagtacgagataattccccaaaggtgcaacaacagcattgcgttgtttttcattaagatcattaagtaattctgaaatatccattgtcgcccataaactgtgtttttatacagttgattatattgttttaaccggaaaaagcaagataagaatcaccgaataaatgctgaagcatatttcgccaactttccttcccaaatgtccaatccgtttaaatatcaaacaaattttctacataactcgaatataaacggttatttcttctctatcatgataaagatgttttgcttgcaattggaaagatatattttgtttatttaacctttcttcaatttgtcgcaggcattgttgaacctcaaaataacgctttttcataggtaattttaagttaaaaatagtttccttacaccaacctttgacgagccattgactgattaaatcagcaattctacgtggctgttcaaccatatcgcaaaccagccagtcaattttacaatgcttaggaggccgaaatttaaagccatcttcagcacaatgttcaattctgccggtctcatgtagacttgttgccattttgccatgatccactgcatacacaaaaacacctcttctcaccaattgataagtccaccctcccggacaagcccctaaatcaacagcatatttattttcgttaaaacgtgttgcttcttgattggggggaataaaataaagaattgcctcttctaattttaatgttgaacgactaggcgcttctgccggaaattttagtcgtggaatccccataatatgttcagcatggttattgttataggaatagccaatgtaacaactgttggattgagtgaaaaaaatatgcagagtaataccgctctttttgttttttgcttgtagccagccttgctttctgagagcttgtctaagcggtacagtaaattttcgacaaaaagcggccagtgttttagcttcattggtatcggcggtttctacccaaatatcactactctgtttgagattgaggattttttcttgttgacgataatattcaataatcggactgatacgatcttgcacggaaagattactaataagatcagatacgacaatcagttggcgagcaaaaatcagttgactaaatgtaatctttctagcgaggagatccgcctcaccgatttggtaacattcaaaaataacatagcctgaattttctactactctggcaaagccaaaaacaccaagtgcggtggctttttcggttatttccgccgccaattctttttcaaagccactgcggcaatataacgctaatttattcatgtttattttgcttcattgcatgcacaatccattgacggaatgcgttaatttgttctgtattggttcgattaagagaatttaccacataaaaagattttggatccggtagagagatagataacacaacttgtaagtttccgttctctatttcgtgttgagcaagaattttatttgccaacacaataccttgtccatgcacagcggcttgtaatgccataaatgtatgactaaataccggtccatgtcgaatatctaatttatccagttgaagtaaattcgccatattacgccagttatctctagtatgaacatgaataagattatgctgatacaaatctgttgcttgcgtaacaggttgtttagcgagtaatttaggggaagccaaaatcaacaattttgcctctgccaatttttcaacttgtaatcccacccaatttcctttgccataataaatggcaatatcaatttcattactcaaaggtatttcgtcttgatcaaccccttttaatctcacctcaatatctggatatcgttgattaaattcacttaattttggtacaagccattgcataccaaaagtttgcggaacgctaattgaaagatattgctcatttttctgagccattaattttgttgtagcatcggctaaattatttagaattttgctgacatcggaaaaataagcccgacccaaatcggttaattctaatgttctatttttacgcttaaataatataacacctaaaaaatcttctaataattttatttgatggctaactgcagcctgtgtaacaaaaagttcatctgcggctttagtaaaacttaaatgccttgctgaactttcaaaagatttcaatgaatttaaaggaggcaaacgtttaatcatcattcttcccaattgtattgtttaaattataacggttgaaattgctatcagattagtttttctaataccatatataaaaaaatatatcttgtctgacctatccattctccatagaatgcacgcatacttaacgattggtaattccttactggttaaagagtttcggacttaagtatgatgttgtgtttgcatattgttcgggaaaccgaaccgagtaacaaattttaagttactcatttacttcctgtatgtatatttaaaccgttttttaggttatgtaccgctctttatgagcggtatttttttatgggcaaaattctatcataaaatttcccatctctatcattccgagcgataaaaatccctttatattttaaatatccagtttccaacctgatgagaatagtgtagattaaattcactattttataaacatcaagaaggaagtaaaaatgaataaaaatattgattgggaaaatctcggttttagttatatcaaaacagattatcgttacatttcttattggaaaaatggagcatggtcaaaaggtgaattgacacaagataatgttttgcatatcagtgaaggttcaaccgcactccattacggtcaacaatgttttgagggcttaaaagcctatcgttgcaaagacggctcaattaacttatttcgccctgaacaaaatgcactacgcatgcaaaaaagttgccaacgcttgttgatgcccgaaattccggtggaaatgtttgtcgatgcctgtaaacaagtcgtcaaagcaaatgcagattggctaggtccttacggttccggtgcaacactttacttacgcccatttttaatcggtgttggtgataatatcggggtcagtccggctcctgaatatatattctcaatcttttgttgtcctgttggtgcatactttaaaggcggtatgaaaccgactaattttattgtttccgactatgatcgtgctgcaccgcaaggaactggtgcggcaaaagtcggcggaaattatgccgccagtctttatccggggaaaatggcgaaaacacgtcattttgcagattgtatttatcttgatccgactacacacaaaaaaatagaagaagtcggttctgcaaacttcttcggtataactaaagacaataaatttattactccattatcgccgtcaattttgccaagcattactaaatattctctactctatctagcaaaagagcggttaggaatggaagtgattgagggcgatgtttatattgatcaattagatcaatttaaagaagccggtgcatgtggaacagcggcagtcatcacgcctatcggtggtattcaatatggcgatcatttccatgttttttattctgaaactgatgtaggtgaaataacaacaaagctttataatgagctggtcggtattcagtttggtgatgttgacgcaccagaaggctggattgttaaagtagaataataaaaaatacacaactaatctgcaatttaatcaagtaactttccgatgaaattgcagattttttctgacataaaaatatcttaacgttgttccaatgaatttaaataatccaagacaatttgatgatgatccgtagttttaaatttatcaaaaacttgttcaatttttccctgttcatcaattaaaaaactaatgcgatgaataccatcaaaggttcttcccataaactttttttctccccaaacaccgaattgttctgccacaatatgttgctcatctgaaagaagatcaaaattcaatgctttcttttctataaaattggctaattttttcggcgaatccggactgatacctaaaataacaacacctttattttctagctctgctttgctatcacgcaacccacaggcttgcgttgtacaaccaggcgtcaacgcttttggataaaaatagaccaatacttttttcccgtgaaaattctcaagactcatctgttcattattttgatttaatagactgaagtgcggtgcaaaatcgccggcttttaatgttttcataaaatattaccttttaaaaaatataaaaaaatacttgcaaagtgttgccattttaacgatcctaaacggactttttcaagctaatatgcaaacataataaggagattttatgaccacacacagacctttattctacggcagtatcaccgcacttatcacaccaatgaataatcatggagaagttgattttaatgcattaaaaaaattagttgaataccacattgtctcaggaactcacgctatcgtttctgtcggtacaaccggagaatcagctaccttaagtatcgctgaaaatgtaaaaacaattttaaagactcttgaatttgccgatggaagaatacctattattgcaggtaccggagcaaatgcaaccagcgaagcgattacgatgaccaagctgttaaatgatagtggtgttgcaggttgtttatccgttgtaccttactacaataaaccaactcaagaaggtatgtatcaacattttaaagccattgcagaatgtacggatattccacaaattctttacaatgtcccgagtcgtaccggtagcgatctattgcctgaaactgttggtcgtttatctcaaattgcaaatattgttggaattaaagaagcaacaggtgatgtcagtcgtgtagcgaaaattaaacagatggcgggggaagatttcattttcctcagcggcgatgacgcaacagggcttgaaagtatgaaacttggcggtcaaggagtcatttccgtcacaaataatattgccgccgctgatatggcaaaaatgtgtgaattggcattagccggaaaatttgatgaagcagaaatcattaataataaattaagtgctttacataaagatttattcatcgaatcaaatcctattccggtgaaatgggcggcttataaattaggattaattcctgaaccgatattacgtcttccactgacaactttaagcgaacaatcgcaaccgaaagttattgaagcattaaaaaatgccggattgctatagtcttcttactaaacattagggtctgcaaacgaccctattttttaaccgatttctacgttaagtgcggttgttttgaggggcaaaataatttttatttttttctgaaggtttgtattgtataattcgtcgcctactgttatgcgtacgatctacgcttatctttttacaaaataaggactttttatgaaatacaaactgtcgttagcgttattatttacgcttccaacctttgcccatgcggggggggtaattttaatttttatggcaaggcggggattgatttaacgtctcgttttgaaacgatgaaaataatattaaattacaataaagaggtaacaaatgttcctgcaagttcaagacaaaacaccttctcaccaagtatctttcttgaaaccacctacaatattttaccacaaacagaaatcggtctcggactaggctatattaaacgcaaaggctttgatcattctgctacttggaagatctcacctgaaggtaatattggaataggtggtgataacaatgcagtggaaaactatagaataaatcgttattcctccctaccaatttatttcacgttgaaacaaaattatgcgttaaatgcaaacagcaaattttatctaaaaggggatataggttattcaatcaacaaaattgataacacaaaatataattactatacagatgtagatcataaaactacaacgactaatcgcaatatgaaagctcaaaacggtctatatttaggtttaggcattggatttgaatataagtctttcttagcagacatcggatattatcatactcatgcaaaagttaattataaaagcgacggaagctattcatggcacccttacaacaacgatgctatacgcttaacacttggatttaaattctaaacaatacaaaacagaataaatcttcaagctaaacttttaccataaaaatccctattgaaatattattcaatagggattttaatatattcaatcggttaaatctttacaaaaacgctacatcataccaaaataaaatgccattaccaccgcactttcccgctttccgtcaggtaaaggataataatttttacgaatatccacctcattaaaacccaaattgtgatatagctgtcttgccttaatgttcgtttctctcacctcaagccataaggtttgtatattacgttctaataattgttgaattaattctttcagtaattcttttcctaaccctaatccttgataatcaggatcgacggcaatattaaacaacgttgcctcatctaacacaagatgacaaatggcaaacgcaacaattttgccattaaccactttctttaaattaagataatgttcgccttgattattttttaatgtgcctaatgaccaaggaacaatatgtgctttttgttcgatcgcaaataattcggcaaaatcttgttcatcaatatatgaaatcattttctatatttcctgaatttgctgccaaaactgacgtttttcctgaggactttgctttaatctctcaagctcattacttttccaacaaggcatatattgcttatcgcttaaagtgcggtctattttctgttgatcatttgtgagtaaccaataaatcacttcatgttcgacttgaagataaggcaaaaaatcaaagttaatacataaacaatcttctttcattagctcaagactacgaaaaatatcttgtaaaaacggttgttcttttaaaaccggctgttcagaaatcataatcaaacgaatattttttgccacagagacatttaccaacccttttaaaatctcgggatggcgtaattgccactgtgaaatacccatttcttgtaagagtttatctcgtctgttcatttctattttcctaaataacaggctattttaaaccgtaaccgaaatgaggttaagcaataattgtgtccatttttagctcttggatttgatataaagtgaaaaaactcaaccgtagaagatcaaacctaaataagaaatcattaaattagttttgaccttctacactccagtagaattttaattcaaactttttgttcgagaagaacgcttacgagaagatttaattttatgaattggagaaagcttcacaaaatcaactccttccggtggattttctagtgcaattgttaagacttcatcaatagtgtcaaccgcatgaatagttaaattatttttcacattttcagggatttcttccaaatctttgacattttctttgggtataatcaccgttttaataccacctcgatgagctgctaataatttttccttcaacccaccaatcggtaatactttgccacgtaaactaatttcccccgtcattgccacttcagattttaccggattaccggttaaacaagaaaccaacgctgtacacatagcaatacccgcacttggtccatctttcggagtcgcaccgtccggtacatgaatgtgaatatcacgtttttcatgaaagtcattagcaatacctaacttttcagctcgagttcttacaacagtcatcgcagcttgaatactttctttcatcacatcgcccaaagaaccggtataaatcaatttacctttaccgattacagatgccgtttctattgttaataaatcaccgccaacttcggtccaagctaatcctgtcacttcaccaatgcggttttgtgtatctgctcgaccaaattcaaagcgtctaaccccaagatactcttgcaaattgttagaattcacttgaatagatttcaaacttttatctaatagcagatttttcactgctttgcggcaaattttagaaatctctctctctaaagaacgaacaccggcttctcgagtataatagcgaataatatctaaaatagcctcttcattgataaccaactcatcagtcttcaatccgttacgctcaatttgtttattcaataagtgacgtgtcgcaatattgagtttttcatcttccgtataaccggagagacgaatgacttccatacgatccagtaaaggtgctggaatattcattgagttggacgtagcaacaaacattacatcagataaatcataatcgacttcaagataatgatcattaaaatgtgaattttgttcaggatcaagcacttccaataatgcagatgccggatcacctcgataatccattgccattttgtcaatttcatcaagtaaaaacagcggatttttcacccccacttttgccattttttgaattaatttgccgggtaaagaacctatatacgttttacgatgtccacgaatctctgcttcatctcgcacaccgcctaatgccatgcgtacatatttacgccccgttgcgttggcaatagaatgccctagcgatgtttttcccacacccggagggccaactaaacataaaatagggccttttaattgatttaagcgactttgtaccgctaaatactccaatatacgctctttaacacgttctaagccatagtgatccgcatctaaggtttcctgtgctttggcaagatcttttttaactttagttcgcttatgccaaggaacttgaaccatccagtcaatataactacgcaaaaccgttgcttcggaagacattggcgacatcatctttaatttttgcaattcggcaaacactttttcacgagcctctatcggcatcttagcctcttctattttcttgcgtaattgctcaacttcatcaactgtgttttcatcatcattcagctctttttgcaatgccttaatttgttcattcagatagtaatcacgttgatttttttctatctgttttttaactctgccacgcacacgttgttcaacttgcaatatatcggcttcgcttaccattaatcctaataaatattcaaaccgtgccgacaaatctcctatttctaggatattttgcttttcattaatagataccggaagatgggctgcaaccgtatcacttaatctctctatatcattaatacgtcgcaatgcagaaataatatctgcgggaatttttttatttaaattcgcatatttttcaaattcggataaagtaattttcttcaatacacttaattctttctcatcactccattgtgtttcaattaattcgtgagacgctaaaaagaattccccattatcttgtaaatcaataagtttagttctttgttgtccttcaacaagaacttttacagtaccgtccggcaattttaacaattgaataatattgactaatgtaccaatcttataaagatcagcgatcttaggttcttcaatgtcaggttttctttgtgaaaccaataataattgcttattattttccatcgcctcctctaaactacgaatagacttgggacgaccaacaaacaatggcattaccatataaggaaaaactaccacatcacgcaatggtagaaccggaagatgctctagcttagttcgttttgcgttcatataatttactctctttcttaaaaatagactgaatgcacaggatatgggggctttttgttaaagttcaagcgaaacccaacctgctaaaacaatcaacatcattctatctaaaatgctacaaaacatgccggcactttcttttgcttatttcggagaaaattcaagcacctgttgtacgaagagtgatgtatctttagaaataaaaatctgcaccttaatcagttgtttattcactccaacttttagtgtgcagatcattttcaagtgcggtgtgtttttataaggatcttactttttagggtgatccataaaacggaagaaatcactacccggttttaaaatcatcatattattcgaaccttcaaagctgttttcataggctttcatactacgcataaaactgaaaaactccggttcttgagcaaacgcatctgaatataattttgctgctgtagcatcgccttcacctcgcaactcttgtgcctttttacttgctgttgccaaaataaccacaactttacgatcaacatcagcttgaataaatgcggctttttctttaccttgtgaacgatgttcacgagccactgcatcacgttcagcacgcatacgttgataaattgaagaagatacttcatcaggtaaattgatctgttttacacgaacatctacgacttcaatacccaattcagcagtactatcttgtcctgtattcaatgctttcttcgcatcttccattaattcaccacgagtaccggatacaatgtctttaatagttctggagccaatttcagaacgcaaacgatcatttactttacggcgtaaaagattcgaggcttgtacataatctccgccactagtggctgtataaaagcgaccgaaatcactaattctccatttaacataagaatcaactaatagatcctttttctctacagtcacaaaacgatcaggttgaccgtctaaagttctaatgcgagcatcaaggattttgacgtgatcaataaatgggattttaaaatgcaagccggggctataaacaaccactttattatctgcatcacgatgtactttactaaaccgtagcataatgccacgagttccttcatcaataatcacaacacttgaataaatcagtgcgaccaatacgataagaataggagttaagaatttacgcattaattaaatctcccttgacgaccttctataacttgataaagactgttcggttgcgaaatttccggatttgttaccgctctttcaggaacctttttttcacttgattgatcagttttaacgagcgtattgcttttctctgctaacgttttactattcaagatctgctctaacggcaatacggttaaattatttccactctgtgtatctaacatgactttcggtgtattcgccatgactttttccatagtttgaatatacaaacgttcacgtaataattccggcgatgctttaaactcaggtaataaacgttggaaacgctctacttcaccttgtgcatccaacacaacttgttctttatatgccgtcgcctgctcaataatacgttgtgcatttccacgagcccgtggctcttgctcacgagcataagcttctgcctcacgaatatagcgttgctcatcttcttgagccttaattgcatcatcgaaagccgctttcacttcctccggagggcgagcagactggaagttcacatcaatcacttctaagcccatatcataaacagcaatgatatcatttaaagttttccaagtattttcacgtacaactgaacgtccggtagttaaaatatcatccatcgtcatatgaccaattacataacgtaatgcactatctgtcgcttgatttaaactgtcatccgctctcgttacactaaacaaatatttcgccggatcttgaacacgatattgcaccgtcatctcaaccttaaccatattttcatcttgcgttaacattgaaccctgtgttcttaattcacgaacccgctcaacattcaccgctgttacgctatcaataaacgttggtttccaatttaagcccggctgaacgattgaatgtaattgtccaaaacgaagaactacaccacgctccgcttcttttatggtataaaacccgcttaatccccaaatcaccgcaccaatcaatacacctaacggtaacaatttacctaaccccaccggagaatttggcttgccgttttttccgacattaccagatttaccactgatttttttcagcaaattattaaagatctcttcaatatccggcggtgattgttgagtattcttttgttggttattcggctgctcccaatttgactgtttatcttcattatgggattgattattttccggttttttccccgtgctacccggcttaccccaaggatcttgatctgaattattgaacgacatttcattctccatttgtcaaaaattgtgacaagtctaaacaaaatattgatctaagtctaatttatttaaaactaattttgcgatttatttggtattcctcacacaaaagcaaaaaaataactcatttttcaaactctgtaatgataatcaccgcacttagaggtaacaacacagaatgatgaaaatcacctttcaaacgaatggataagaacaaaaaatagttatttaatagcaaaaaattcagaatgagaaagttattcagaagtgataaaaatcgccgaatgatcggcgattttgtataaaatgaatcaatctaaccgtttagacatagctaaccaatcggctttaaattcacgacgcatattattaattgcatcaataatatcatgatgcaccaattgttcattttggataccgacacaataaccacctttgccctgtaataaaagatctacagcgtaaacccccatacgagaacctaaaatgcggtcaaaagcacaaggcgtaccgccacgttgaatatggcctaaaatagttgctcgagtttcgtgttttacacgggcttcaatttctcgagccagctcattcacatcacataataattcagtgatggcaataattgcatgacgcttacccttaataatggcacgctcaatttgcttaattaattcttcacgattaaattcaatttcagaagcaacaatatattcacaaccacctgcaatagccgccgagatcgtcaaatcgctacaatgtctgcccataatttccacgatagaaatacgcttgtgtgaacttgaggtatcacgtaaacggtcaattgcctcaactgcggtttcaagtgcggtttgataaccgatagtataatcagtgccagcaacatcattatcaattgttccaggaataccgacacaagggaaatcatgttcttcagtgagtaattttgctcccatataagaaccgtctcccccgatgacgacaagtgcatcaataccatgtgaacgtaaaatttccacgcatttttcacgtacggcaggatctttaaactcagggaaacgagctgagccaaggaatgtaccgccccggttgataatatccgatacgctatagcgagttaattgttggatcttgttgtgatataaaccgtaataaccttcataaatcccataaacttccaaaccctcggataaagccgaacgaacaacaccacgtatcgcagcattcatccccggtgcatcaccgccacttgttaaaactgcaattttttttatcatattacttacctaatgtattgttaaaattaatcttcaaaaaaacagtgccaaggttacactattccttgccgtcgctctataaaaatttttgtgaattgcaacacaatttgatctagtttaaacttttcagctcaacttgaacaacgctggttggctcttgatgaatcgcaatatcagtgtaagaaaatcgctgtctcaattgattttctatatcttccgtaatttgatgagcttgaagaaaagacatatgatcatctaattctaaatgaaattggataaaacgaaccgcacctgaacgtctagttttaagatcatgaaaacccaaaatacgtttatctgctaaaataatttgttctatgcttttaatttcttcatccggtaaggcaacatctaaaagcaactggagattatcaaacaagattttacctgcattaatcaatatataaaaagcaattaaaagagcaaaaatcgcatcggcttgttggtaacctaattggctcaacgataatgaaattaaaatagtaaaattcatcaataaatccgtttgataatgaagtttatccgctttaattgccggactgcctgtttgtttaatcactttgctttgatatatcactaacaatgcagtagctaaaatcgaaaataaggttacaaaaacaccaatctgaaaattcatcaagggttgtggtgtatttaagcgatgaataccttgcagaagaataaataccgccgatccggaaataaatgcactttgccccaaaccagcaagagcctcagccttaccatgaccaaaagaatgattatgatccgccggcatcagtgcaaaacgcaaaatcagcatattcatcaaagacaccaataaatccaacattgagtcagtgatagacgctaacatactgacagaactcgtttgccaccaagcgaaacttttcactaaaattaataataaagcggtaaaaatagctaaattggctgcttttttcacttgttgggaataaatacgttccatttatacaattaccctcattgataacaaccgactattttatattgttcgagctgtgcgatttctttatccacaatatatttttttaaatagcgttcaattttatgtttactcattgctgatgtgggagctttcattaacttaaaagaatattgatattgaataaaaccacaaaaaggaatctctttaccttttgcaatatctacttgccaagttggatttttttctgtcggttcataaatcacaaagctgtaaagctcattatctttcaaataaagattaaattgcttcacaccgttattctgataaacatgtcgtctcaatgttatacgatccgacaaactacgtttttcacgattacgatcatgtaataattcaaccgcactttgccagttttcaacagtatgctctttcggtaaataaaagtaacgggccacagtttccaaatctaccgcactgacaagataataacttttttcatgatgcttaatatattccggtacgtttactcgagagtgtgatacacaggctgacaataaaagtgcggtcaacatagctaagattttgttcatttaattacatctcgcttaaatacaaattccgtttgtgttgaagaggatggattaaactgatacccccctaaatcaaactcttttaattgttcaatgtcagtgactcgatgttgaataatatagcgacacatcaaccctcttgcttttttagcataaaaactgatgactttatattttcctcctttgttatcaaggaaaaccggcttgataattttcacctctaattgattttctttaatggatttataatactcatctgaagctaaattaacgagaattttatcgccttgctgttcaattgcttgttgcaatgcgtcggtgatgatatttccccaaaaagcatataaatccttgcctttttcatttgccaattttgttcccatttctaaacgataaggttgcattaaatcaagcggtcgtaacactccatataatccggataatacacgcaaatgctgttgtgcaaattgaatatcgtcccgacttaatgtttcaacctccaagccggtgtaaacatcacctttaaaagcataaattgccgcacgagaattttgttcattatgctctatttgccattgttcaaagcgtgcggcatttaagccagcaagtttatcgctaatcgacattaacgaacttatttgtgccggtgaaagttgacgacaaatttttatcaatttttcgctatatgcagttaagtgcggttgagaaaaagcaaaattcggtaccgcactttcccaatctaacgttttggctggagaaataatagctaacatgttctttcctcaaatttatatcgtcattggcaattgccaattaatttcagttaaattgtgatgtcgtaaatactgattggttttggaaaaatgcctacaaccgaaaaatcctctatgtgccgacaatggcgaagggtgtggcgaggttaaaacacaatgcttagtgcggtcaataaattgaccttttttctgagcatgactaccccaaagcaaaaaaacaagatgatcacgttgttcatttaaaacatgaataacacgatccgtaaacgtttcccaaccaaaattcgcatgtgaatgtgctaatccctgttcaacggtcaacaccgtattgagcaataatacgccttgctttgcccaaccgaccaaatagccatgtgaaggagtttgaaaccccataatatctgttgagagttctttataaatatttaccaatgaaggaggcggtgctatgccgggtttgactgaaaatgccaacccatgtgcttgattgacaccatggtaaggatcttgacctagaatgacgaccctaacctgatcaaactccgtcagtctaaaggcactaaatacttcttcttgaggtggataaattgttctaccgctttgtctggcttgttgaacttgctgtaaaatatgctggaaataaggttgttgtttttcttgcccaattgcctctttccacgtattcatgattttcctcatattgatatgccaatcttaagcggcaattataaagaaagaataataaaatgcctagtttggatttgcttaatatgtataggttatttttaaattttgctaaatttaacgccttgattacgtttcaatccaatatattttttcaataaaattaaaccgctctatatcaaattaattgaaaatataaaattttttgataaaatttgcaccagttcaattcgtgaaaaaacataatgattaggagcatattatgattaaaggtatccaaattactcaagcggcaaatgacaatttattaaactcgttttggttgttggacagtgaaaaaggcgaagctcgttgcttagcggctaaagcggaattcgttgaagatcaaatcgtggcagtaagcgagttaggtcaaatcgaatatcgtgaattaccagttgacgttgcaccaacaattaaagttgaagggggtcaacacttaaatgtgaacgtattacgtcgtgaaacattggaagacgcagtaaataatccggaaaaatacccacaattaaccattcgtgtttccggttacgcagttcgttttaactctttaacaccggaacaacaacgtgatgtaattactcgtactttcacacaaagtttataatttccatctgatctgatgtgccgtattcccacatactttaaaacgtggaaatacggcacaaaatattctcgtcgactttactctccgatcttaccttattttttattgcaacaccgaaatgtctgctacttgtaaaaagagattttgtagcgtgcttaaaatcgctaagcgattttggcgaagcgtttgttcttccacatttaccattactccgtcaaaaaacgcatcaatcggctgacgtaaattcgctaatttatccaatacagccgtgtagtcgccttgtgcaattaacggttgcacttcgccttttaaggcaataaccgcttccgccaacgttttttctgccgactctacgcaaacgcctaaatcaatctcaccaatcgcaatatcggctttcgccaaaatgttactcacacgtttatttgcggcagctaaggcttcggcactgtctaatgtacggaaatgagaaaccgcacgcacacgagcatcaaagtccgctggtttggtcggacggcgagccaatacagattgaatgacgtctactgcaatgccttcactttcataccatgcacggaagcggccaagcataaactctactacttcatcaaccacatttttattcgtcagtttgtcgccaaaaagtgcggtcgcttttgccacaatgtcagctaaatccaacggcaagtttttctccacaataattcgcaaacaacccagtgcggcacgacgtaaagcaaacgggtcggcactgcctttcggggattgtccaataccgaaaatccctgtgagcgtatcaattttatccgccaatgcaacagaacaagcgactaacgaattcggcaatgtatcaccggcaaaacgtggcatatattgttcgttcaacgcaaccgccacgtcttcatcttcgccatcgtggcgagcatagtgcatacccattacgccttgcgtatcggtaaattcaaacaccatattggtcatcaaatcgcattttgagagcaagccggcacgtttcgctttcgtttgatccgccccgatttgtgctgcaatttcgcctgctaaggcttcaatacgagctgttttatcacgcaatgtgccaagctgttgttggaataacacggtttcaaggcatggcaaccgatcttccaatttctgttttaagtctgttttgaagaagaattccgcatcggtcaagcgtggacgaaccactttttcgttaccttcaataattttgctcggatcgtccggattaatattggacacgaagataaagtgcggtaataattttccgtctttatcataaatcggaaagtatttttggtcgcctttcatcgtataaaccaaggcttccgcagggacggcaaggaaacgttcttcaaatttagcggtcagtacattcggatattcaactaatgacgttacttcttccaacaactcttcttcaatatccgccactccgccaagtgcggtcgctttttctcgagatgttgcaaggatcaacgctttacgttcattgaaatcggctaccacagaaccacgttctttgagcaattgcggatattgatcggcgtgatcaagactaaattcacgctcacctaaaaaacgatgtccacgaacggtacgcccgctcgccacgcctaaaatttcgccttcaatcagatccgcaccgaataaaagcgttacggtatgcaccggacgtacaaactgctcggttttatcgccccaacgcattgttttcggaattggtaatcctgcaagggctttatcaataatgcctacaagcaagtttttagtcggctgaccttcaatcactgcacgatgcaccagccattcgcctttatcggtggaaagacgttcggcttgctcaacggtaatgccacagcctctcgcccagccttccgccgctttggtcggcttaccttcggcatcaaacgccgccgatactgctggcccacgtttttcaacttgtttgctcggttgagcctctgccagccccaacacttttactgccaaacggcgaggggctgcaaaccattccactttctcaaaagccaaccctgcttgatttaactcttgctcaacattctccgcaaatgcggtcgctaattttttgagtgcctttggtggcaactcttctgtgccaatctcggcgaggaagttttgtgttgtcattgttatttctcaactatacgttttatttaaatccattggctaaacaaattgctttgttcgttttttggggtacttttactcaattcttcacatcgtttttacgtctaccaaataccctaactcaataaaaatcaaaaggttacgttttacttgatatcgtttttaactcgttttcttattctacactattttagatagaggcaaaacaagattgcttttgaaaacgctcaatttgccttttcgttgtactgcgttttagcgttttaaaaatcaatctaaactcatatcaaagtaacccagaaaagaaaaagaaaaagaaaggataaagagaagagaagaattttattttttttgctataaatttagacaattttgtagcaaatttataacgagatcagtataattgcacacttaactaaactagatttaatcatttgagaaaataactcaaatcaaccctattaacattaatcgaataagaagcagaatatgagcctacagcctacagcctacagcctacagcctacagcctacagcctacagcctacagcctacagcctacagcctacagcctaggctaacgcctttttataaaccttgcaaaataaattttaaaaaatttttaacttctcgtcatacccaaatytacccttttcaamcccttagcgaaratatcattcgcctttttctgctttgccttaaaaagcaaggtattgcctatttagggttatcccctctctctaaagtttaataaataatcagtaagagataataaataaataaccaataacagattcgatcaataaccacttaataagtaattaacagataatttttaaagcgagtaattctatgaacaaaatcttcaaaacaaaatacgatattacaacaggtcaatgtaaagccgtttccgagttggcaagtaatcgccaaatagcgagcagttcgaagagtaaaccgaagtgcggtgggtttttcggtggaaatttaggggcgtttaaggtgttgccgttggcgttgttgatgtcggggatgcttggtgtgagcagtgtttcatatgctgatatagtatatatagatatggatggagaaacaggagctgcgggtgtaaaaaaggactggagtgaagcacaatattggaagaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtatgacgatattgggctataatgcagtcggttacgaaagtcaagcaacagctttaggtaataatgtatattcagctggacaaggtgtagcacttggatcggatgtaatggctgcgggtcttggttctatagcaatagggaatgatgatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggattggtactaatgtatataaagaaaactctgttgctatcggtacgggggtcaatgttgccggtgcgggcgttgtggctatcggttcnnnnnnnnnnnnnnnnnnnnnnnnnnnnnnnnnnnnnnnnnnnnnnnnnnnnnnnnnnnnnnnngaaagtatcgttttgggaaatgatgcaagtctaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcgatggcattaggtaatgaaaccgaagcaacaatggaaaattccgttgccttaggctataaatccaccaccaaatatttctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagcgattacagggaatcagctgaatcagcttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaggctgggaatacaaaggttgaagataaggcactaaaaacagaaactcaatattcaagtaataatatcagaacagcatatcaatcgaataacaaaagacttttaatcggcataaaagaaaatcctacatttaaaaaggtatccttagaggaagaacaaacatataattctgatccaaaacaaaataaagtcggtaaaaagaacttaattactaaaggctatttagacggtgcattagcaaatgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacggtgccaaagcctctagtgcaaaaaattccgtggtgattggtaggggttctgagtccaaagcacaaagtgcggtggtactcggtaaaggtgcgaatgttaagcaaaacgccacaggtgcggtggcgattggggaaagtgcgacagttgaagaaaatgcaggcgattccattgcgttggggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcgtaggggataagggtagcgagcggattatcaccaacgttgccgcaggtaaagtcgaaaccggctcaaccgatgccatcaacggcggacagcttgcggaagtgattagcgtttttggtaaattaggttttgatgtacttggtgcagagaaacatgatagtgaagatggttttaaacaatcaacttttgcaaaagttgagtataagagagcctcgcaaggaacacagcaaggacaacagcaagaacaagcaaaagccccaacaacctttagagaagctattaatgaaagcattacggctattaacaagggcttgatgttcagtgcggatcaaagtgcggtaacaaatggcactcaaaacacaccgcactatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaacgccaaaatagaaatcggctttaaaaatgcaccgatgtttgaaaaagttacgctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtttacgaacggacagaatatccaagttactgtagcaaatggaaatggcagtgcaacacagccaagtacgagtgcttctgcttccgcaccggctccaacaccagctgctccagcaccgtcgcctgctccagcagctgctccgtcgcctactccggcaagtagcacaactacaacaccaaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagtgcgggcggaaatggtgctggttcaaatgaagaagtcaccaaacttacgttaacaccagaaaatgcgacattccaagtyggaacaacaggtkctaaagtsaaaatyrataaagagggtatttcactyacnccacaaggggcgaataacacaggcggagcaaatggagcaaatccatttgccgatacagcatcaatcactattaaagcaggtgcaaaaccagcggatccaaaaagtttagattcacttgatcctaataacggaccttcaatagagttctcagccaagaaaacaagtgatggtaaatctattggcacaggaaaaatcaccggtctgaaagatttagaagcaaattctgacggctcaagtgcggtgaataaaaactatgtggataaactggataaagtgrcggtgaaatatgatrrtgaasmkaaarawwcmatcactttaggcggtaaacctcaaaatggaggtaaggctcatgmccctgttgccatcaamaayctmaaatccggtttagggcttgatgatatgaaagataaaccggattctcaaaaaaatggattaagtcttgaactagtgaaaaaactggtttcyracggyatragtagccagcaaggrcaamaaatgacaraasawgacctgcaymragcsgcyaatctcgctgayttaaaagcggttgcacaagcwgggttgagatttaaaggaaatcagggcgatgatgtagtyagaaaaatcagcgatacyttaacyattaaaggggaagaaaacgctacaactggttctagtgccactgacaagtttaacagtacgacaaccgccgctggtaacattaaggtagaagccaatacagccaaaaacggcttagaaataaaactgtcggataccttgaaaaatatgaaagcctttgaaaccaaagaggatggcggtaaaaaagccacgttaaatagcgagggcttaaaagttgtgaacaaaggcaaagacggtaatagcaaaggtacctctgccacctatggtgcggacaatatcatgttggaagataaaggtaaaaacaataaagcmryrrtwaccgckgaaagtcttacctttgctgacaacgtagcacaaaatcagcaaaatccaatgccaaaagctgttcttaataaaaacggcttaaccgtaaccggcaaaggcggtgaaattaagattgatggtgaaaacggtattattaccgtaccggatattaaaccaacaaccagtgaaagtgcggtggtgaataagaaatatgtggatggtcaactcagtgccgctgtcaaccgcttggataatgtgatcagtgccaacaacaaacgcttgcaatcaggaattgccggtgcaaatgcggcggctgcattgccaacgattgctatgccgggtaaatcggcacttgcagtctctgcgggtacctatagagggcaaagtgcggtggctttgggctactctcgtgtgagtgacaacggtaaaattatgttgaaactacacggcaacagcacctcaaccggcgatttcggtggtggtgtcggtatcggctgggcgtggtaagctgaggtcaaactatcaaaaaaagcagtgataatctgttccttagtcagttgtttttttaatccaacttctaggtgaagatcagaatcactgcttttttgtttgttggtgcgttgtttgcctgagaacaatgagcgataaaaaatagtcagttaaatactgaataacgatgccataatgtataggtgaaatttcgagataaaagcaaaaatctattacatcatttcattactaataaatttagcgtaaaataatgccatctataattacatagcagaaataaaaatgagcctacaagcctacaagcctacaagcctacaagcctacaagcctacaagcctacaagcctacaagcctacaagcctacaagcctacaagcctacaagcctacaagcctacaagcctagtatattggctaaaaacaaccttgcaaattcattatgaaaggttgttaatgtctaaacaaaaatccaagaccaatcaatctcaatctattactaaaaatagttttcgtttttttgatgcctataaatcattcatagatttaaaagattgttgtttatttctcagaacgaacgatatcaatactattggtatgtttgcagttaatgtacttgcatttcctcacaaaaaaacaccgcactaaaataagatgttccgagaagataatatgaatttaattatatgctgtactccattacaggtactcatcgccgaaaaaattatcgaacgttatcctgagcaaaaattttatgggattatgttagaatcattttataacgataaatttgatttttatgaaaataaattaaagcacttatgccatgagtttttttgtataaaaattgcaagatttaaactagaaagatataaaaatttactttctttattaaaaattaaaaacaaaacttttgatcgtgttttcttggcgaatatcgaaaaaagatatatccatattattttaagtaatatctttttcaaagaattgtatacttttgatgatggtactgcaaacatcgccccaaatagtcacctctatcaagaatatgatcattctttaaaaaaaagaattactgatattctattacccaatcactacaattccaacaaagtaaagaatatatctaagctacattattcaatttatcgttgtaaaaataatattatagataatatagaatatatgcctttgtttaatctagaaaagaaatatacggcacaagataaaagcatctcaatactattaggtcaacctatattttatgatgaagagaaaaatattcgattaatcaaagaagtcattgcaaaatttaaaattgattattattttcctcacccaagggaagattactatatagataatgtttcatatattaaaacaccgcttatttttgaagagttttatgcagaacgatctattgaaaatagtattaaaatatatactttttttagtagtgcggtattaaatatagtaaccaaagataatattgaccgtatctatgctttaaagcctaaattaactgaaaaagcatatttagattgttatgatatattgaaagattttggtataaaagtgattgatatctaaaatttttagcaaaaaaaaataaataaatgatcttaaattaatccgtaataatgaactttattattcactttataaagcaagctgaggagtaaatgttacggtaagttcaaccagttcatctaaagagattattttcatttgcggtaactgtacaaatattttttcacttaaatttctcgcctcaacatcaggttgtaaaaacataacaggtatattaaggcacgtaaaaagttgagggtgctttaagggtaataaaacagcatcttgccataaaactaatacatcttgtggtgtgatttggtctaaataaccggttaattcatttatgtcgtagcttgattgagaaaaggtatagagcatattatttatccctaaaaagttaaaattttctctgcctgatttagtttttgtagcaacaaagtgcggtcaattttttgacaggaaataataaaatcttggctatttaattgatatttttcacaagattgccgacaaatatagcgttgctcgatttcatacaaatccaataatttaaaggtactaatgaaatctttttgcaaaataatttcaggtttctgctgattaagtaaattaaaaacaccatcttctaagaagaagaccgcaatttcatcttcattacaaaatgccgttgccgccaacagtgcatctaaaccttctcggctaatactgctaccatgtggtgcttggcgaaagataaaagccagttttatcatattgttatcaacctatctgcttgcaaaactgccttattaaactctcctaatcctgccaaaataaaaccttctgctaaattattttgttgctggttatttgaactcagcggttcaacgatacctcgccgttgtgctgctgaaatacaaagatgcaatggaacagaatatgtttgacttaactgttgccacgctttttgtaagtgaaattcgtcatttgctggattaacaaaggcattacctaaagttaccccttgttgaaaaaaaaagatttgttcaatttgatgacctttcgccaataaggtttgtgcaaattgataagcaagatatgccccttgtgtaccataaacaggctgtttaaccgctaaaacataacgcattattctattccttgctcttgtttgagttgacggatatagagataaacggtatgtcgagagatatttaagcgttccgctactaaattaatcgcatctttaatatcaaaaatacctttttcatataaggacaggacaatttgacgatttttgttatgatttgcaacaagacgatccgctgtaatttcttcgacagtttgttctatagtttgaacaacaagctcctctactgaactggcgaaattaactgctgacatttccacttgttcaggtgcgggcatcaatgcctgaataaattgagacatgggaatatccaaattaatattaatgcaaagtaagcctataatgcgttgattaccgttacgaattgcaatcgtcaccgatttcatcaatcccttacttttagatcgagtaaaataaggtttagacacactctcggtttgcatattgtgcaaagacgttaatgcaaaatttgtaatcggcgaccccacttggcgattggtattatgtccattggcaatacaaatagccgaatgctcaaggtcttccaaagagtgtaaaacaatttcacagtgctcaccaattaatgcactaatcccctcaaccacagcgatataagaattgagaatagtatgatcttcatttgtaaaagggcgtctatccgataacatgcttaatttcccttatttttctcaccgcactttaggctatttttaatgtaagtgcggtgagttttactttatttttcagaagttacatctaagatttcaatatcaaaatatagcgttgaactcggtggaattaggcctgcacctctttcgccataagctaagtcggcaggaataaccaactcaatttttccgccttttttaatgaattgtaaaccctctgtccaacctaaaatcacttgatttaatttaaattcagcaggttgtccacgctctctagaactatcgaatactttgccattggctaatttgcccgtgtaatgtactttaacacgatctgtcggtttaatgctcttaccttctcccattttttcaatacgataaagtaaaccactttccgtttttttcacattcgattttttagcaaattctgctgtaaatttctcattttcagctttgattttagccatttttgcatgacgtgctttgttttctaactcttgcaacgtttcttgtgctttttcatcagttaaagtgcttttattttctacaacatctttaatgccagcgacaattttctcataattgtaactggcaacatctttgtgttcttcacccatcaccgttaaatattttcccataaaatagcccaaagcataagaaacatcatcattgaactgcttatcagcaaaaacagattgagaaacgaccgcacttgctattaacgctattgcagaacgttttttaatttttaacatttttcttgatcctttataataaaaatatgaaatgttgaatagattaaattgtcttgttcaaatgcacaatcattattttttaattagagactatttatgccacaaactcaagaattagatcaacgtattgcagaattagaaatgaaaattgcctttcaagaaaacaccttagaagaattaaatcaggcattaattgatcaacaatttgttttagacaaaatgcaactacaattacgctatatggcaagcaaattaaaggatttacaatcttctaatattgcaactcaagcggaagaaacacctccgccacattattaacttattgataaacatcaataatatcaagaggataggtttttccggataaataatcttccacggcttgtaataccaaaggattgcgagccgcttgtccatcttgctgaatataatggtgaaactcctccaagctcaaccaaagccctccggaaatatccggatcagaaggtgttatctcaacccaatctgttaactcaacagaaaaaacaaaccgtaaataatcagttttagaacgaggtgcatgccattggtaaatctttaataagttttgcatctctgctcgaataccggtttcttcaaataattctctttgtgcaccctgtaaaatagtttcatttttttctagatgcccggctggttgattaagtgtcattttgccgtattcaaactcttcgacaaataaaaatttacctttgcagtgcacaacacaagccattgtaatatttggtttatacatattagatactctttttaacttgttgatataaattttgtaattcggttaacgtaagctcacgaaattgtccattggctaaattggtgagcgttaaccccgctgtttcataacgaattaaacgcaatgtgggaaaaccgatatgggcagtcatacgtcgtacttgacggttacgcccttcgctaattttaatttccagccagctggtaggaacagttttacgctcacgaatcggaggatgtcgttgccaaatattcggttcagaaatcaagcgcacttttgccggtttagtcaatccatcattcaattcgatgccttttctcagctgtgcaagatcggtttccactggaatgccttctatttgtacccagtaggttttttccattttaaattttggattcgtcagtcggtgctgtagctcgccattattggttaacaataaaagaccctcgctatctcgatctaaacgtccaacggggtaaatgtgcggtatttttataaaatcttttaatgttgcccgcccttgttcatctgtgaactgacagagaacatcaaaaggcttgttgaataaaatcactttagtttgtgcaaagttaagtccccttttttgcctacgtttcagcaccgcactttttacaagcgattttatcaagttagtgttgtttaattttttgcgttgaagatccatgttttagataaaaataaataagggcaagccattagctgcccttatgctgattagatttttgccaaaatattattcaatgttgctgaaggacgcatggcttgtgctgtagccttggaatcagggtgataataaccttgaatgttttgcgacctcccttgtgcagcaagtagctcttgattaatttgctgctcattttcttgcaaggcttgtgcaattgactcaaacttcctgttaagttgttcatctttgttttgctctgctaaggcttgagcccaatacattgccaaataaaaatgcgatcctctgttatcaatcgtccccaatttacgtcccggagatttattcttatctaagaaaattgcatttgcctgatctaatgtttctgccaaaatttgtgcttgagcgttattttgcgtttgagcaaggtgttccaacgaagcttgtagtgctaaaaactctcctagcgaatcccaacgtaaataaccttctgcaataaactgctcaatatgttttggtgcagaaccgccggcaccagtttcaaataaccccccaccattcatcaatggtacaattgaaagcattttggcagaagtacctaattctaagattgggaataaatctgtaagataatctcgcaacacattaccggtagcggaaatcgtatccaacccttgacgaatacgatttaatgaaaatttgcaagcctcaatcggagataatattttgatgtctaaatgtgttgtatcaaattcagccaaataagaccgcacttttttgataacttcacgatcatgtgcacgattttcatctaaccaaaaaacaaccggcgtattggtaacgcttgctcgattaactgcaagtttaatccaatccttaattggagcatctttcgtttgacacatgcggaaaatatcgcctttctccacatgttgcaccaagtaaatttcgccatcttcaccaaccacttgaattaccccttgctcttcagcttggaaagttttgtcatgtgagccatattcttccgctttttgtgccattaatccgacattaggtactgaacccattgtagtaggattaaaggctccgttatgtttacagtcttcaatgaccgcactataaatccccgcataacaacgatccggaatgagagccaaggtatcttgtaattccccttttctgttccacattttgcctgaattacggatcattgccggcatagaagcatcaacaataacatcagaaggaacatgcagattagtaatccctttatctgaatttaccatagcaatatcaggtccttgctccattgctttttcaattgccgctttgatttcattttccttagcatggccggcgattttgctataaagctcacccaacccattgttcgggttgatgctaagttgagtaaacacatcagcatattgtgcaaaaacatcggcaaaataaacagaaacaataacaccgaaaatgataggatctgatactttcatcattgttgctttaagatgtgttgaaaataacgtaccctccgctttagattgagcttttgcttgtgctacaaaatcttttaacgcttgtaaactcatcactgaggcatctattacttcaccagcttttaacggtgcaaattttttcagcactttcttttcaccgtttgcagccacaaattctatttgaaattgtcccgcactttttaccgttacggatttttccgtaccataaaaatctccttgttgcatgctgacaacttgggtttttgattgtgcagaccaatcgcccattgagtgcggatttttctgtgcataatttttcactgcttttggtgcacgtcgatcagaatttccctcacgtaaaacgggatttaccgctgaacctaatacttttgtgtaagccgcttttatttttttttcttcttccgtctgtggttctgttggatagtcaggaacagcaaatccttgttgttgaagttctttaatggcggcgttaagttgaggaatagaagctgagatattcggtaatttaataatattagcttccggtttagtcgccaattcccccaattcagcaagggcatcaggaattttctgttcctcactaaggtaagcagataaattggctaaaattcgccctgcaagagaaatatctttggtttctacatcaatatttgcgacagcagtaaatgcttgcacaattggaaggaaagaataagtcgccaacattggtgcttcatcagttaatgtataagtaatttttgctgacataggcatgttcctgtatagatatgaattggttaattggaatgaatttgctctttatggtattagagcgttctaagcataacaaaaaaataacaataatgttattttatgcgtacaattttttcaaaatttaaacaatatctggaaagaatatatacagataaatgatatttatgtcataatccaagtaatttcattttttattttaggagctattatgtcaaaaccattaaattttgtgatgatttctccacattttcctgcaaactttgaaacttttgccgttcgtttaaaggagtgtggttttaatacattaggtattgcagacacaccttatgaacagttaagtgaaaacttgcgtagttccttaacggaatattatcgtgttgataatatggaagactacgagcaagtctatcgtgctgttggttattttgcacataagtatggtcgaattgatcgtattgaatctcataatgaatactggcttgagcttgatgcaaaattacgtacagattttaatgttcccgggtataagaacgatgatatgttggcaattaaaaccaaagcacaaatgaaagaaatttttcgtcaagcaggtctgaaagttgctcagggaaaagtatttaactctgatgatgaagcacgtaagttagctaaaaaattgaagtttcctgtgattattaagccaaattcaggagtgggtgcaagcgatacttataaaattaagtcggtacaagaattagaggactttttttcttataaaaatgcacacgttgaatacatcatggaagaatttattgatggggacattattacctttgatggtttaaccgataaagagggcaatattgtgttctattccggtcttgaatattccgagtgcgtattggataccgtagaaaatgataacgatatgttctattacgttcctcgagaaatttcaaccgacttaattaaattaggacaaaaatgtgttgatgctttcaacgttcgtgagcgtttcttccattttgagtttttccgtgtgaaaaaaacaggtgatttgatgccgttagaaatcaattgtcgcccacccggtggcttgactatcgatatgtggaattatgcaaatgattttgatgtattcagagaatacgccaatattgtgaaagaaaataaattctacacaaatattacacacccatggaatgtggtatatatctcacgtaaagcaaataagaattatgtaaactccattgaagatgtgcaacaaaaatattctactaatattattagtgtgcaaactgtaccctgcgtttttgccaaaattatgggggaacatggcattttagctcgcacagaaactttagatcagatgcatgaaattgcacaatttgcacaacaaaaagcgtaactttgttttaatttatagacaggatttccctgtctactgtaacttttaggaaaaaaataaatgcactttgaaagacgtagccattggagcggtgaattgggacgtgaaatgcactttaatgtgtatggtcatgcgggtaagcctgtgattgtatttccttcatccggtggaaatcaaaatgaatatggtaactttggtatgattgaagcttgtcgttcttttattgagcgtggcttaattaaattttatacacccgactctttcgataatgaatcttggctggcagaatggaaatccggacatgatatggcacaagcacacaatgcttatgatcgctatattttaaatgaacttgttccactaatccgtcatgaatcaaaatgggacggagcaatgattgcgacaggttgtagtatgggggcattccatacaattaactttgctttgcgtcatccggatttatttgatgttgcaattgcattgagcggtgtttacgacgcacgtttctttactcatgaatatcatggtgattctaccgtttattttaactcgccaattgattatttatggaatcaacatgataactggttcttagaacgttatcgccaaaatcattatattgtggctgttgggcaaggtgcttgggaagaacaacatatagcggatacaaaacgtttagaagaagcatttcgcagtaaaggaatagaaggttggtttgattactggggtcatgatgtggatcatgactggccttggtggcgagttcagatgccatttttcctctcaaaattggaggaacaggggattatttaatcaataaaggaaaacataaaaatctatggagatctcaaaaaatcttactacggtattcatgttccttgtattggtcataatttatatgaaattgcttatcaggcaatcagtttagcggttcgagaaataaatgatagaaacaagatcatttctaaaattgtcattagaagtcggctgatagatagtaataaataaaaaactaaggggaattcagacttaaagaacaaaattagtgatcaaaacctagttaaatccttataataaatacaaggagttaactaggtcagagacttttgatgcacattgcagtagtaatgatcttcaaaaatacgaccaaaattaaggctaaacaacgttataaatgaaaaagtgagcataaatctgctcactttttgatgctccaactacaattccttatgaattttagaattgtctttgtttatttaatggagtattacttaataatcttagcaacaacacccgcacctacagtacgtccaccttcacgaatcgcaaaacgtaacccttggtccatcgcaatcgggtgaattaagcttactgtcattttgatgttatcgccaggcatgaccatttcaacaccttccggtaattcaattgtacctgttacgtcagtagtacggaaatagaattgtggacggtaacctttgaagaatggtgtatgacgtcctccttcctcttttgacaacacataaacttctgattcaaagtctgtgtgcggtgtaattgaaccaggtttcgctaatacttgaccacgttcaatttcttcacgttttgttccacgtaataatgctccaatgttttctcccgcacgaccttcgtctaataatttacggaacatttctacacccgttactgtggtttttgttgtctctttaataccgacaatttcaacttcttcaccagtacggataataccacgctctacacgtccggttactactgtaccacgtcctgaaattgagaaaacatcttcaatcggtaataagaacggttggtcaatcgcacgctcaggctccggaatatagttgtctaagtgagacgctaattcaagaattttttcttcccactcagcaactccatttaatgcttgtaatgctgaaccacgtacaattggtgtgtcatcgcccgggaagtcgtattgagaaagtaattcacgtacttccatctcaaccaattccaataattcttcgtcatctaccatgtcgcatttgtttaagaatacgatgatgtacggtacacctacctgacgacctaataagatgtgctcacgagtttgtggcattggaccgtctgttgccgctaccactaaaatagctccgtccatttgtgccgcacctgtaatcatattttttacatagtcagcgtgtcccggacagtcaacgtgtgcgtagtgacgtgtcgctgtatcatattcaacgtgtgaagtgttgatagtgataccacgtgctttctcttctggtgcgttatcaatttggtcaaatgcacgtgctgcaccaccaaagtgtttggataatacagtcgtgatcgctgctgttaaagttgttttaccgtggtcaacgtggccgattgtacccacgtttacgtgcggttttgtacgttcaaatttttctttagacacttttcagtttccttttattgagtccccaaaagtgcggtgcaaatttggggagttttgttgattaaataaaattattttttacgtgcttcaattactgcatccgccacgtttttcggtgcttcagcatattttaacggttccattgaatatgatgcacgaccttgagtttgtgaacgtagatccgttgcataaccaaacatctctgctaatggaacttcagcattgattttcacaacaaattcgtttgcttcttgaccgcttaccatagcacgacgacgacttaagtcaccaattacatcaccaacataatcaggtggagtttcaacttccactttcatgattggctcaagtaacactggatttgctttattaaatgccgctttaaatgctagagaagcagcaagcttaaacgccagttcagatgagtcaacatcatggtatgaaccgaaatgtaaacgaacacctaaatcaactacaggatatccagctaatggaccggatttaagttgttcttggatacctttgtcaacagctggaatatattcaccaggaattaccccacctttaatttcgttaacaaattcatatccaggaccttcaggttctagagggtataaatcaataactacatgaccatattgaccacgaccaccagattgttttgcgtgttttccttcaacatcgtttacacgagtgcggatagtttcacgataagatacttgtggtttaccgatatttgcttcgaccttgaattcacgacgcatacggtcaacgataatatccaagtgtaactcacccatacctgaaataatagtttcacctgactcttcatcagtgtgtacacggaaagacggatcttcttgagcaagacgccctaatgcaagacccattttttcctggtcagcttttgtttttggttcaacagcaacagaaataaccggttccgggaattccatacgctcgaggataattggtgcatccattgcacataaagtatcaccggtacctacatctttcagaccgattgcggctgcaatgtctcctgcacgtacttctttaatttcttcacgtttattcgcatgcatttgcacgatacgaccgaaacgctcacgtttgtcttttacagaattcaatacagttgcacccgattcaacaacaccggaatatacacggaagaaggttaaattaccaacgaatgggtcagtagcgattttaaatgccaaagctgcaaacggttcatcatcactggcatgacgctcaccttctgtttcatccggattaatacctttaatggcttcaatatctgttggtgccggtaaataatcaattacagcatcaagcatcgcttgaacacctttatttttgaatgctgatccacaagttacaaggataatttcagtttttaatgcacgtaaacgtaaaccttttttaatttcttcttcagttaactcatcacctgaaaagaatttatccatcaactcatcagaagattcggcagcggcttcaactaagtttgcacgccatttttcacattcagcaagcatctctgcaggaatatcttcataggtaaaagtcatcccttggtctgcttcattccagttgatcgctttcattttaattagatcaacaacacctttgaaattatcttctgcaccaataggcaattgtagaggaacagcattgccacctaaacgtgttttgatttgctcaacaacacgtaagaaattggcaccggtacggtccattttatttacgaaagcgatacgcggtactttatatttattagcttgacgccatactgtttctgattgaggttgaacaccaccaaccgcacagtaaaccattaccgctccatcaagaacacgcattgaacgttctacctcgatagtaaagtctacgtgtcccggagtatcaattacgttaatacgatgttgtggaaattgttgcgacatacccgaccaaaatgccgttgtagccgcagaagtaatagtaataccacgctcttgttcttgttccatccagtccatggttgcagcaccatcatgtacttcaccaattttgtgacttacacctgtatagaacaaaatacgctcagtggtagttgttttacccgcatcaatatgcgcactgataccgatattacggtaaagtgaaataggggttgtacgagccattattatttccttgtttggaataaatttaaaatatgaacaaggctccaccgcatagtaatgtgatgaagcctaaaaaacactttgctactctaccaacggtaatgtgcaaatgctttattagcctcagccatacggtggacatcttcacgttttttcactgccgcacctttgttctcagaagcatctgataactcattagctaaacgcaaagccatagatttatcaccgcgcttacgtgcagcttcaacgatccaacgcatacctaatgcgttacggcgagttggacgaacttcaaccggcacttggtatgtagaaccaccaacacgacgagatttaacctcaactgttggacgtacgttttccaatgcaatttcaaaagcctctaatgcttctttacctgtacgttgagataacgtttctaatgcaccataaacgatagattcagcgatggattttttaccatctaccattaaaacattaataaatttcgcaagtaattctgagccgaacttcggatcaggaagaatcttgcgaggttcaatacgacgacgacgtggcattgtaatttctccgttttttatcttcaggattatccaaaactctttatgtaagaaatgacatcttacttttactggagtttatggtaattaatttgttaattagcgtttggccttacttaacggagaaccattaagctttaggacgtttaacgccgtatttagaacgactttgtttacgatctttaacgccagcacaatccaatgcaccgcgtactgtgtggtaacgcacccccggtaagtctttcacacgaccaccacggattaacactacgctgtgttcttgaaggttatgaccttcaccaccgatataagaagttacttcaaaaccgttagttaaacgaatacgacatactttacgtaatgctgagttcggttttttaggtgtagttgtgtacacacgagtacacacgccacgtttctgcggacatgactctaacgcaggaacgttgctttttacaacctttttcacacgcggtttgcgtactagttggttgatagttgccattaataaaactccaatagtttttacaaaaatgtatatttaataatctatctatacaaagatagacgccgaattctaatcacacaaagtgatattgtcaagaattaagcaattctatcctgcaaaaataacgaaagattccatttagattgggtgaagatctatgctttaagtttctcaatagtttttttatcaaagaaataatgtgtaccacaacattcgcattgcatatcaatactaccgccatgttctgttaaaatattttcaatttcatcatcggaaatcaaaagtaatgcagatccagaacgctctaaagaacaaccacaatgaaattccaccgcacttggtggataaatctccacagtttcttcatggtataagcggtacaatagttcttctgcagttagtccaaataattcttcattttttactgttgcagctaatgtcgcaagatgttcaaaatcctcttgtgaaccggtaccatcaggcatgatttgtaataataatccggcagcaacaggttttccctcatattcaccggaacgaatcaataattgtgtttgtagctgttccgaacgaatgaaataatcctctaagcactctgcaatggttggtttatctaatgcaatcactccttgataacgctccccatttgttggggctatagtaattactaatataccattgccgactaactctgataaggttatatcatcatacacatcatcttgtaaacgagccaatgcacggatttgttgactatcactgccgttaactaacaataattttaacggaccgttaccttgaatttgtatggtaatattgcctttgaattttaaagttgctgtcaataaattggtagcgaccatcatttcacctaataaattccgtacaatacgaggatattcatgtgagttaagtgtatcggtgaaagtcttattcaaacgtacccactcacctcgtacggcacgatctttaaataggtaacggtaaagtttgtcattatctgtttgatatatcatatatttttcctgtttattcaaattttcaatatctatcgtctttataaattgaatgctattcctgatacttaaacttcaataaatctctccgctcttttttatttggacggcgatctgggtgtggcatagaaagtacattattcttacgtgcgattgccattttctctcgctgttcaacactcctagtggtttcacgatacaacaattgtgcttccggtgcaccacgacgttgtgcagatagggctagcacttctacttctttttcttcactaccttgacgcaatttgagtattgcaccaatttccaccgttttatttggtttagtacgttggttattataatgcacctttccaccgtcaatcatttcttttgcaatagtacgtgttttataaaagcgtgcagcccatagccatttatcgagccgaatactatcatctttttccttgggtaaatgctgttttgccatatttgtcttttcgttcagttaaaatcaggggtatgatagggggattaaagacatttgtaaaagggaagattatgaatgaattaaaaagtcaggtactgctggaaaaggttttacaaatcgctcatcaagctggagactatcttaatcttttttacaatggagaaattgattttcagatcaacataaaatcggataatacgcctatcacaaacgcagatttatttgtaaaccagtttcttatcgaaaaactgaccgcacttacgccacatatccctgttttatcagaagaaaactgtcaaattcctttttcagatcgacggcggtggcgtacttattggttgattgatccgctggatggtacacaacaatttattaatcgaacagatcaattcgctgtgctaattgcactgattcatcaaaatcggagcatgttaggtattattcatgctcccgtgttaaaacaaacttattatgccctgaaagggcatggtgcttataaacaaacggaacattctctacaaactttatcagccagaaaatttgacttaaaccatacagtaaaaattgcagtaggttcaaaaaatgcggagcaaaaagtgcggtcaattttgagctcaaattatcaatacgaatttattacttatggttctagcggtttaaaaaccgcactggttgcagaaggaagtgcagattgctatattcgactgggacaaaccggtgaatgggacacggctgcggcggaagccattttatccgaaataggcggaggaatccgtgatacccaattcaacgccctaacttataacaaacgaccgagtttaataaaccctgattttattatggtatcagacatatctgccgattggaaaaaaatctttcaatttaattaatgagaactattggaaatttagctgatttcagaatattattcacttcttttaatatcggacttagacaaaatatgaacgtaaatgcagaaaataattgtattgttatttttggagcttcgggagatttaactcaccgaaaattaatccccgcactttataatttatacaaaataggacgtttgacagaaaatttctctgtgttaggtgtttcccgaactgacttaagcgatgaagaatttcgtgaaaaaatgcgtaatgcgttgagaaaaacagaagatataacagaagaacatttggaaaaattttgttctcatctttattatcaggcgattgatacctcgaatgcttctgattatggaaaacttgttcctcgtttagatgagctacatgatacatatcagaccggaggcaatactctttattatatgtccacaccgccaagcctttacggtgtgattcctgaatgccttgccacacacggactaaatacggaagaatgcggttggaaacgtcttattgtagaaaaaccttttggttatgacataaaaaccgcaaaagaacttgatgtgcaaattcatcgtttttttgaagaacatcaaatttatcgtattgaccattatttgggtaaagaaactgttcaaaaccttctcgtattacgtttttccaacggcttatttgaaccgctatggaaccgcaactttattgactatgtagaaattacaggtgctgaagaaatcggtgttgaagaacgtggcggatactataatgattctggtgcaatgcgtgatatgttccaaaaccacttattacaagttttagccatggtagcaatggagccccctgctattattaatgctgattctatgcgtgacgaagtagcaaaagtgttacattgcttacacccgctcagcgaagacgatataaaaaacaatcttgttttaggtcaatacacatcttcaactatagatggtgaagtggtgaatggttatttacaagaaaaaggcgttccagcagactccaatacagaaacctacattgctttacgttgcgaaattgataactggcgttgggctggtgtgccattctatgtgcgtagcggtaaacggctacccactcgtgttacggaaattgtcatacactttaaaacaacgccccatccagtcttcagtcaaaatgcaccggaaaataaattaattatccgaattcagcctgatgaagggatttcaatgcgtttcggcttgaaaaaaccgggtgcaggctttgaagcaaaagaagtgtcaatggatttccgctacgctgatttagcaacaccaagcctactgagtgcctatgatcgtttattattagatgccataaaaggcgatgcgacactttttgcacggacagatgcagtacatgcctgctggaaatttgtacaacccatcttgaattataaaaaagatcaagggcgtgtttacgaatatgaagctggaacgtggggaccgacagaagcagataaattaattgctaaaacggggagagtatggcgtaaacctagcggaatgatgaagaaaaaagtctaaatcaaataaatagtaattaaacgtaataacacttgccataaggaatacgaatgaatacaaaaatttttgatacggctcaacatgcagttgaacaaatcgctcaggaatttgtgcaatatagcaaacaaaatcgtgcggtgcatatttccctttcaggaggttcaacgcctaaattgttatttaaaacccttgctcaagagccgtttaaaagcgaagtgcggtgggaaaatttacatttttggtggggagatgatcgtatggttgaaccgaataatcctgaaagtaactacggtgaagtgaaaaaattactgttcgaccacattaggattccaacagagaatattcatcgtattcgtggcgaagaaaacgtagaacaagaacttgcaagattttcgcaagagctgattgcatgtgtaccggatcttactttcgactggattattttaggtatgggagcagatggacatactgcgtcactctttccttatcaaaccgattttagtgattcgaatgtagcggtcatcgcaaaacatcctgaaacggggcaaattcgtatttcaaaaaccgcaaaactaattgaacaggcaaaacgcattacttatttagtgaccggtgaatccaaagcggacattttaaaagaaattcagaccgcacttccggaaaatttgccttatccggcagccaaaattaaagcaaaaaatggcgtaacggagtggtatttggataaagccgccggaaaattattgttatcttgatctattaattgcttaaatcagtggagcttattatgaaaaaatggttttctgtggtattaattgcgatgctttctgcttgttcgattcaaggaatttttgaaaagcaagatgtttcaacacagtttgaaattgttaaacgccgtgtgattgaaaaacacaaagtccctcaaggcatacctgacggtgaattttcaggatctgacagttcatatggacgaacatttaaaacgtttgttaaacatggctatattgataaatactttgatatttaccacccaaatggaaaattacattctcatacggtgttagttgatggtatcgcacaaggttggtcttttggttatactcccgagggcattttacgaacaaaactgttatataaagatggtgcagttatcgaaattattcttttagatgaaaaaggtaatgttattcaacatattaaacaaaaagagggataaattatgtcacaaaaaggtgatataggcgtgattggactcgccgtaatgggtcaaaatttaattttgaatatgaacgataacggctttaaagtcgtggcgtataaccgcactacgtcaaaagtggacgaatttttagcaggtgcggcgaaaggcacgaacatcatcggagcctattcattggaagaacttgccggtaaattggaaaagccacgtaaagtaatgttgatggtacgtgcgggggaagtggtggatcaatttattgaggcattactaccgcacttagaacaaggcgacatcattattgatggcggtaactcaaactatcccgatacaaatcgtcgtgtaaaagccttagctgaaaaaggtattcgctttattggctcgggagtttcaggcggtgaagaaggtgctcgccacggaccatctattatgccaggtggcaatgaagaagcatggcaatatgtcaaaccaattttacaagcaatttcagccaaaactgacaaaggtgaaccttgctgtgattgggtaggtaaagaaggttcaggacattttgtgaaaatggtgcataacggtatcgaatatggtgatatgcagttaatttgtgaagcctatcagttcttaaaagatggcttaggtttaagctatgatgaaatgcaacagatctttgctgagtggaagaaaactgagcttgatagctatctaattgatattacaacagatattcttggatataaagatgcggacggcgagccgttagtcgaaaaaattcttgatactgcagggcaaaaaggaacaggtaaatggacagggatcaacgccttagatttcggaattccattaactttaattacagaatcggtatttgctcgctgcgtatcctctttcaaagatcaacgtgtggcggcatctaaactcttcaacaagactatcggcaaagtggaaggcgataaaaacgtttggattgaagctgtgcgtaaagcattattggcatcaaaaatcatttcttatgctcaaggctttatgctcattcgtgaagcctctgaaaacttcggttggaatatcaattacggagcgaccgcacttttatggcgtgaaggttgtattatccgtagccgtttcttaggtaatattcgtgatgcttatgaagccaatccggacctgattttcttagggtcagatccatactttaaaggcattttagaaaatgcgttaagtgattggcgtaaagtggtagcaaaatctattgaggtgggtatcccaatgccttgtatggcaagtgcggttactttcttagatggttatacttctgagcgtgtgccagcaaacttgttacaagcacaacgtgattactttggtgctcatacctacgaacgcactgacaaacctcgtggcgagtttttccacactaactggacaggacgtggtggcaatactgcatcaacgacttatgatgtataattcaatctcaacacaaaaaagcggtgaactgatcaccgctttttatgtttttaaactaaagaaatagtcaatttatacaagttattcattaattgcatgatttactttgtagttaaggggtaagttgtttacaatgcacaaagattttttattcatcaggattaaaaaatgaaaactgtcaaaaaaagcaaattaattatcaccgcactgagtgcaatgttattactttcggcttgtgccactatagatgagcaaaccggagaacgtaaagatcccttagaaggatttaaccgtgtgatgtgggattttaactataacgttgctgatccttatgtgctaaaaccgattgcaaagggttggaaagaatatgttccacaaccaatcagaaagggattgactaatgtagcgaacaatcttgatgaacctgccagcatggttaatcgtttgttgcaaggtgagtttaaaaaggcaatggtgcattttcatcgcttttggattaattcaatctttggattaggtggactcatcgactgggcaagttatagtgaacctctgcaaattgaaaataaacaccgtttcggtgatacgctaggtacttatggcatggaaacggggtcttatgtaatgttaccgctttacggaccggcaacacctcgtcaagatctcggcaatcttgttgatgtaacttatccgatgttatccttattaggtccttgggggctactcaaatcgagtatacaacgccttgattctcgtgctaatctgcttggcaaagaaacattattggaacaatcaaaagatccttatgttacattccgtgaggcttatttacagaatgtagatcatcatactcatgatggacaaataaagagaacgcaagaagaattttctaaagaagacttaaaagacatcgactaaactcaagaaggaatttattatggaaatgacctcaactcaacgcttaatcttagccaatcaatatagattaatgggtttattggatccgaccaatacacaaaaataccaacgtttagaagctattgtgaaaggcggtttcggcttagaactgaaagaattggataaagagttttccgatctttcggaagcggaatgtctcactgtattaaatactttggagatgtataacgcattacaaatttcttacaataatttgccggataagtccgctttgacaccgcatcgcttacaatttgcgggctattgtgcagtgcgggagaaaaaatatcttaattacttacgctttatcacctcagtcgaagggaaatatcaagagtttatgcgttgtgaacatggttgcgactcccaaactccaatgtgggataagtacctcaaaatgcttgacgcctggcgtgcctgtccccatgaatatcatttaagcatggcagaaattcaaaaaatcttaaatgcttaattgagtcaacgttggtaaaaaaaccgcactttataaagagtgcggttttttatgtagtttctatcagtaaatttgctacaaccggtggaatacttttggggtgaggaataagaatttgcttatgccgactcagttcacctttttccaaaataatctgactttttgccactttgaaagttttacttaaaaatttcaacaagtgagcatttgcctgtccgtcaatgggtggggcagtaatactgattttcagtgcgttatcatatagtccgataaggtgatctttgcttgctttaggttgcaaaaagatcctcaaacgtaaattatctccaattttttccacagcaggcatacatttctaccaattctgacacgatttaagccaacgcccaataatttcctaataaatcatacattacacgattgccataaaataaaataaaggcaagtaacatgggagaaaaatcaaccatccctgttctaggtagtaggcgacgaacaggtttgagcaagggttctcccaattgatgtaataaataacttaaagctccacgattaaaccaacttaaaatcgctcctaaaaataaaatatataaaaacaattcaccaaaagttcttaaggtgtgtaataacgcaataattacgctttgtccaatgggaaaacgtgcacccactatcgcaaaaatcatatgatattttaatatgcctaatacaaagacaacaaagagcggtgcaaaattaatattttttattgtcggcaaaactttttgcagaggcaaaataattggattagtgaatttcaccaaagattgtgaaaaaggactataaaaatcaacacggcaatactgaaaccacatacgtaacataaaaagaaaacttaatacgtcaaaaatagtattcaataaaaactgaattgaatttaattgataaatcattataaccatcctttacgtttaaaataccaataaggtgcaaatgctgctaatgccatcagacccaatgccagcggatagccgaacttaaaacctaattccggcatattactaaagttcattccataatttgatgctactaacgttggcggtaaaaaaattaccgatacaacggagaagattttaataatacggttttgttcaatattgataaagcccatagcagcttgcatcaaaaagtttactttttgaaataatgactcattatgcggttgtagggactcaatatcacgcaaaatttctcgagcttgttctaactgattggtaggtaaacgtgttttacgcactaaaaaactcaatgcacgttgagtatccattaaacacaatcgtactttagaactggtatcttcttgttcagtgatagttgctaacgcctgatcaaaagcctcaccttgtttaccttctaaaataatacgactcaatttttccaaatcagcgtacacattttcaattacgtcagctaattgttcaattttagtttcaaataagtctaataacacctcataggcattacattcaactaaacgttgattgcgtgaacgcatacggtataaacgaaatgccggcaattcacgatctcttaaagtaaataatcgcccgtcacgaatggtaaaggcaacgctggctaaatcggcataatcattttcatcttcgcaataaaagaaagagtgtaaatgtaagccatcttcatcttcgaaaaaacgtgcagacgcttcaatatcctctaactctaaaaaagtggctaaattttgcccaagtccttcctgtaacaaatcacgctcttctttactcggctcaagtaaatccaaccaaaccgcattattcaactctttatcagcactttcatcaatacgaaccaaacgagcatcttcgagtgaaaaagcattaatcattttgtcatgctcctctaaagggattatgaacaacgcaatgaacaaaataaaatcaaataagacacgtataaagtgcggtgaaaattatatttgattaaaagatacctgaaaaataggtaatggaacttacctgcgtaatcccgccgataagtgctagaaagacaagacgagatttagaaaaaagataataggtatcgactatgactgtccaaagtgtatgtcctcttgttactaaatcgtgcggaatgttacgcttgaaatagctgttcgtcaaggctttttgcaataaaaatcccactaaaagcgggatcttataaacaactttcgatttgactactttgtagggtaatcccaccaaatatcgaataattcactgatttcaatttgttgtaaaccgtttttctccaaccagtttttcaccaaagtgcgatgactttcatcacattttcccaatttttccaagcaaactaaaccttcccaatgaagataaccgctaccttcgtaagcaagtccgttttcttgaataacttcacgaataaaacgatcaacgacttcatctacttgctcaatagaggtgttttctgcaaattgccaattcactaaaaagccaagctcttggaattctgctaagtgcatttttttacgttgtctttgattacgtttaatcgccatacttttctcctattgttactattcttgtcaggctgggcaatcatagcatatttatcgcctgtccttaataaaaaaacaaaatccgagcttatattaattatttgttgtgaagtaatgaaaaaaatctttgtatcgctggggaaataaatttgtctttataaaaaatataattaatccctctttcaaaagttaagttttttaatggaatttcaactaacagttgactatgcaattcatgcgttacagccagtcttgaaataaaggaaacccccaaattattgattacacaatgtttaattccttctaagctgttaaattccattatttttagttgtgtaatttgttcatggtcaaaatgttgaaaaataaattttcttgtttcagaaagattaggtttcatgatgagttgttgctggctaagtgcggtgaaatcgcatgctgttttttttgctaaaggatttttaggtgaagcaattaaaatgagttcgtcagataaaaatctgtgagtttgataggtttgcggatcaaaataaatttgatccgacataatcaaaaaatcaatttggtgattttctaatttatgaatgagttggggagaaggtaaaatatcaatacttagcttaacgttaggtgatatttttttatattcggcaattattttcgggagcaaataaacacccacaaaatggctggcaccaatagtaatttttccgtagttgggatcatcgtattgatggagatgttctattgaagtttccaatgtagaaagtgtttgctttgcataattttggaaaatcttgccttgttcggttaaataaagtcgattattaattcgctcaaataaaactgtatttaatgactcttcaagttttttaatcttaatacttactgacggttgcgtacaaaagagtttgttcgcagtttctgttacatttaaacattcagaaagtactataaaagctttaagttgacttaaattcatatcaattccataaaaataatttatagcttgtatagaataatacaatttttttatgtttaatcaactctctataatcagattattctatagacaatatatggagtaactcaccatgaatgacacagtaattcaaaatcaagaacaccaatctgcccgaaaagaatggctgaaaaaaatcggtattccgctagctttaactatattgcttgtattgatgtttatgccaacgcctgaggggttaacaatacaagggcaaaaagccattgctattttctgtggtgcgttaactctttgggtctgtggctcaatccctatttatttaacatctttgttagtcattattttattgccattaactcagaccgttgcaaaagataaagttgttttcgctactcttggatatgatgtaatttggttaatggtatctgcttttgtgctaacttcagcaatgattaaatcaaatattgctcgacgttttgctttatggatgatcactcattttggacaaacaccacgtaaggctatgtttgttttggtattaattaattttatattagttttcttcgtaccttctaccactgccagagcttcactcatggtaccaatttgtttaattttactggaaatttatcgtgcggtaccgggtgaaagcaattttggtaaattaatgatgttacaaggtgtgcaagctgatgcaattgcaacatccggtgtaatgacaggaactgccggtaatattattgcagttggatttattaataatcaagctggcggagatattggttatcttgattggcttttagcatctttccccgtagcttttgttaccatgataatttctttcttaattggttttaaactgttctcaatgaagaaagaaactcatttttttgaagctttatctcgtcttcaagcagaatataaaaaattaggttctttaactttagatgaaaagaaagctatggcaatctttttgcttacggttctactttgggcaacggaaagttatcaaaaagcatggttcggcttcaaaattagtgtttatatgaccgctgtgatagcagcagttctctgcttaatgccaagaattggattactcacttggtccgaagccaaaattaaatgggatttaatgctgtttgctgccggtgcttatgcagcaggtaacaccttagaatcgactaaaggtgctcaatggattatggacaaagtcgttcatggattaggtttagaaacaatgagccatacggctgtttatgtggtagtaatcttcgtatgtatgtatgtatagccacttgatttttaccagtaaaacggtcaaaacgacaattcttattccatctattattgccttggcacaatctttagggatgaatcctgtaaccttagctttagctgcgtcatttacactgacatatactataacgttgcctccacattccaaagtaaacacaatttattttgccactggttattttagtgtgttggatcaaatgaaatacggtttggttacttgctttatcggtgcctcgatcatttgtttatcaatttttacttggttccaattacttggatataccttataaaaaaacggagaggaatcatgcgattaattttattacgtcacggcgaaacgctatggaatcaagaacatcgcctacagggacaccaaaactcgccgttatctgaaaaaggtattcagcaagcgaaagcaattaagcctttgattgagcaattctcacctaaatatgtgatcagttcagatttggggagagcactacaaacagcggaaattattggttataaaaatccaattaaagacagtgagcttagagagttggcaatgggagaatgggaaggttgtagaaaaacggaaataatagctcaacatccggctttatatcaggattggcgtaatggcgattacacaccgaatggggctgagagttggcaagcattttgtcaacgtatttcacaagcactactaaaatgggcaaataaatacgatgacgatattctagctattgttcatagcggtgtaattcgagcagcttgtgaatctttagtatcgctatctactaagcatcttttgcctgtaactcaaggaacattgacgatttttgatatcagtcctaatctacctataaaactggaggcttacaatttggggagttttattcccgccagcaatgtagcggactaaaagattatttattttaaaatctagtaaaaaataaccgcactttatagactctgtttaggatttaaagtgcggtttatttttgttaggatttattttatcctttgcattttatatttttctaagttgcttgaaaacgaatttatttagaaacagttgctttaattagtttttccgctttagctaaactattttccaccgctgaataaggggtcttagagtggctaactacttgttcggcagtatttaataacactttcacttcgcctttttctgcttcggtcactaacacctttaatggtaattgtaatgcaagactgggatctttaaccatcaatggtgtgcctgcttttggggcaccgtaaataattaccgttgcaggttgcattgttagccccgattctttagccgctttttgatgatcgatttttgcaaaaatggtcattcctttttctgtgagtgtatctgtaagtacagttattgtttggtcaaaactgtatttactttcaaaagattgtggttgaagtacatcgctatgtgccattgcgacttggcttgcgaaaagtattgaaaaaagagctattttcttcataaattacctcgttatgttatgtttttaataaaaaataaatcccaaaccccatgtcctaatttatgtccacgttgttcaaacttggttaaaggtcgaaaatccggacgtgggatatagtcatttgtggcggaagtattacgtaaacctaccgcacttgttaatacctccaacatatattccgcataattttcccagtccgttgccatatgaacaaagccgtttggtaccagtttttgttgaattttttcaacaaagtgcggttgtacaattcggcgtttatgatgttttgttttatgccaaggatcggggaaaaatagttgtaatccggctaaactattgtctgcaatacagtcttgtaagatctcggttgcatcatggcaaataacacgtagattttttacctgcttttcaactgcataagcgatgcaagcacctactcccggcgtatgtacttcaataccaagataatttttatcgggattttgtagagccatttctactaaagatttccccataccaaagccaatctccaaaatcacagggttggtgttgccataaatctgtgtgaaatcaaaagcagttgtttgatactcaagtcctaatgttgcccaattattattcatcatgttacgctgaaattcgcttaaacgtcctgtgcgtaatacaaagctgcgaacttttcgtttataacgtccatcttcagtaaattcagctatttcaacggtctttcttttttgatcggcaaacgtaatcttttgttctgtcatttcatttgactacttgttaatttggggggcaaattataaggggtttaatagaaaatataaagtgcggttaaatttatcaattaagataaagccgcactttttatttgattatgttacacttctttttattttgattacctaaattatgcaggctcaatcctctattaacaatccttttgcttatacagtacttaaatggtatcggcaattcgggcgtaaaaacttaccttggcagcaaaataaaactctatatggtgtttggttatccgaggtgatgttgcaacaaactcaagtagcgacagttattccttactttgaacgttttattaaagtttttccaaatattaccgcacttgccaatgcacctttagatgaagtgctacacttatggacaggactgggttattatgcgagagctcgcaatttgcatagggctgcacaaaccataagagatcagtatcaaggtgaatttccaacggattttcagcacgtgtgggctttacccggtattggacgtagtacagctggggcggttttatcttcagtacttaatcagccttatcctattttggacggtaatgtaaagcgagtgctgactcgttattttcaggtgcaaggttggactggtgataaaaaagtagaggataagctttggcgattgagtgcagatgttacccctacagagcaggtcgcagattttaatcaagctatgatggacttaggtgcgatggtttgtactcgtacaaaacctaagtgcttgttgtgtccactagccataaagtgcggtgctaatttaaacaataattgggtagattttccgtctaaaaaaccgaagaaatcgttacctgagagaaaaagttattttctgattttggagaatcaaggtaaggttggtttagaacaacgccctatttcaggactttggggcggattatattgttttccgcagtttgataccctgactgaattattggcttatctttctcagcaaggtattcaacaatatcaacaatggacggcatttcgtcatacattcagccattttcatttagatatttatccaatttatgcacaaatacaaactgaggaagtggaatttgatcgcacagattggaaaaaaattgcagaaaataacgtagaatattgttctcctatatcaagtgcggtcaaatattggtatgatcctaccaatccaagccaaattggtttggctgtgccggttaaaaatttattgatcgaatttcaaaaaaggaaataattatggcaagaaatgtgttttgcacttacttaaatcaagaggctgaaggattggattttcagctatatcccggcgagttaggtaaacggatttttgacaatatcagtaaacaggcatgggcggaatggatgaaaaaacaaaccatgttagttaatgagaaaaaattaaatatgatgaattccgaacatcgccagttattagaacaagaaatgacaaattttctttttgaagggaaagatgttcatattgagggctatgtgcctccgacagaaaaataatttaacatgaaaaaatatattgtatttgcgattattccttttctttttgcttgtagtagttctacgctaaatgatgactatgatgaagcttttgcaaaagatactcaaggacttgatattttaaccggacaattttctcataatatcgatcaaatttggggagtaaatgaactcctcgtggcaagcagaaaagactatgtaaaatacacagataatttttacactcgcagtcatatcagctttgatgaaggttctattatgattgaaacattgggtgataaaagtcgtttatatcattcgattattcatactttattaatgggtgcggatgcaaaaggaatcgatttatttacctccggcgatgtgcctatcagttctcgtccattcctcgtcggattagttgttgatcataaaggtgcacaagttaaaaatatgacaacagcaagtaattttgcaaattatcttttacaaaataagttgcaaacacgttaccttaccaatgggaatcctgtacagtatgttattattccaatggttgcaaaccatgttgcagtgcgtgcccaacgctatttacctctaattcgaaaagccgccggacgttatgggatagatgaaagtttaattcttggtattatgcaaacggaatcaagtttcaatccttatgcaattagttatgctaacgcaataggtttaatgcaagttgtacctcatactgcagggcgagatgtattccgtttaaaagggttaaacgggcaaccgtcaaaaaaatatctctttaatcccgctaaaaatattgatacaggtgttgcctatttgactttattacgggataaatatttagatggtataacaaatccaacttcaaaacgttttgcaatgatttccgcttacaatagcggtgccggagcagtactacgagtgtttcataatgatcgagatatagcaattaacaaaattaatcgcttatatccggagcaagtatatcgtattcttactactatgcacccctctgagcaagcaagaaattatttacttaaagtagataaagcacaaaaaagttatagggtgattaagaatagcaaatctgatttgccttaataaaccataacaaaagaataattaagttacgcatgcttaaaagctaagatatacttaactgacttttcattaaacttattcatggagaactgttatgactgccctttttaccactgctcaaaactggctcgctcaagaccctgatgcggaaactcgtgcagaattacaaacattactcaaccaagccaaagtaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctgatgtgttcgtacgagataccgctgaaattatggctggtgcgggcatcaaaaccttccttttgccacgaaaattgccaacacctgtactggcttacgctatcaaatacctcaacactacggcaggcgtgatggtcaccgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacactgtgttagacgatgaaatcgtagatgcttatatcgcaaaaaccgcctctattgccaaagagccacaagcaaatattaactacgtttacaccgcaatgcacggagtaggctatgaagtgttgagtaaaaccttagcgaaagcaggcttaccacaaccacatttggtcgaagagcaagttcaacctgatggctcattcccaacggtcaatttcccaaatccagaagagaaaggtgcgttagatttagcaattaaactggcaaaagcgaaaaatgccgagttcatcattgccaacgaccctgacgcagaccgtcttgcagttgcggtacctgattcggaaggcaactggaaacctttgcacggtaacgtgataggttgtttcttaggttggtatctagcaaaacaataccacgcacagggcaaacagggcaaattagcttgctcactggtttctagtcctgctctggcggaaattgcgaaaaaatacggtttccaatccgaagaaactttaaccggtttcaaatatatcggcaaagtgaacgacttattgttcggctttgaagaagctttgggctacttagtcgatccagacaaagtacgtgataaagacggaatttcagcagctattgccttcttagatttagtccgtagcctgaaaaaagagggtaaaacactaacagattacgctaatgactttactgcggaattcggtgcatatgtaagcggacaaatctctattcgtgtgaacgaattatcagatatcggcaaaatgatgaccgcacttcgtaaagaaccactaacagaattaggcggtttcgttacacaatttattgatcacagcaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaggtacggaaaacaggattgctaatttagcataaacacaaaagcacgttttatacctacctgttattttatcgactccatataaaaatcaccgcacttttatctcaataacgaaacaaaagtgcggtagttttacagcaaaatcagataaaattatccctgtgaagaaatacgtttcatgtctgtcatataaccacgcaattcctgaccgattaattcaatcggatgctgacgaattgcatcatttacatcacgtaacaaaatattatcgatttctgttgctggtgttgactcacctaaatcaccacgttttaacgttggaataatttctttagctaaaattggagctgctacgttagcaaataaataattaccatactcagcggtatcagagatgactacattcatttcatataaacgcttacgagcaattgtattggcaattaatggtaactcgtgtagtgattcataataggcagactcttcataaattcccgtttctaccattgtatcaaaagccaattcaacgccagctttaaccattgctaccattaatacgccatgatcgaaatattcttgttcggaaattttaatattttctcctttcggtgcattttcaaatgctgttttaccggtttgttcacgccatttcaataaattagcatcaccgtttgcccagtcttccatcatgacacgggaaaattcaccgctgataatatcatccatatgttttttaaatagaaaatccaatttttctttaatttgctcggaaagggaaaatgcacgtaacttagcactattggataaccgatccatcattaaggtaataccgccttgttttaaggcttcagtaattgtttcccaaccatattgaattaatttacccgcatatgccggatctttaccatcagcgattaacttgtcataacatactaaagaaccagcctgtaacataccgcataaaattgtttgctctcccattaaatcggattttacttccgcaacaaaagaagattccaaaacaccagcacgatgtccaccagtcgccgcagcccatgctttagcaatggctaacccttcacctttcggatcgttttcaggatgaacagcaattaacgtcggcacaccgaatccacgtttaaattcttcccgcacttccgtcccaggacacttaggagcgaccattaccacagtgatgtcctgacgaattttttctcccacttcaacaatatttaaaccatgcgaatatcccaaagctgctccttgtttaattaacggcataacatcagcaacgactttagagtgttgtttatctggtgttaaattaatcaccaaatccgccgtaggaattaattgctgataagttcctacaacaaatccgttttcacttgctcgctgaaaagaagcacgtttttcctcaatagcttccggacgaagggtataagcaatatccaaaccggaatctcgcatatttaaaccttgatttaatccttgagcaccacatccgataatgacaatttttttaccttttaagaaattaacgtcatcggcaaattcctcacgatccataaagcgacaacgacctaactggtcaagttgttgacgcaaatttaatgtattgaaataattacccatttccaatctccttatgtaatattccgctggttataaccaaattaaaatttacggtaaaagcattatacataaatttgctattgcgtaaattgactttattgaaaacttttatttcgttttctcaaatagatctgtttttgtttgtaatttatttttttaatttaaagtagtatgaaaaaacagtataattaagkggttagttaattttttcttaacttcttaattttaagaataatttcttttttgggggaataatgagaatatttaaatcaataaaacaattctttgttaagccatctgcaaaaatagggttaggtatccttttggtcggcggtgcctttgtaggaattgtaggttggattatctttaatgccattcttgaccataccagtcaagaagaattttgtataagctgccattctatgcaatatccattagaagaactcaaacaaaccgctcattggtccaatgataaaggggtttccgcaagttgccctgattgtcatttacctcacaatacggtggataaatatattcgtaagattcaagcaacaaaggaaatttttgccgaattaagcggtaaaatttcttcgaaaacagactttgaaaaacaccgtctagaaatggcagaaagggaatgggcgagaatgtccgctaacggttcggcggaatgtaaagcttgtcacagctatgatcgaatggattttgataaaatgtcggagattgcacgcaatgccatgatacctgcagctgaaaaagatcaaagctgtattgattgccataaaggaattgcacatcatcttcctgaaatgtcacattcatcatcaaaaggcaatggtttaccatcaaactctttacaagcaaataaaatctattatacggaaaataatgtcgctctttttgcagatgaaacaatggggcaagaaatcgggcagttagaaactggtgtaccagtacattttgtgaaaacaacaccaaacgcggatttagttgaactggaaatgtggcgaaaagacaaaggctttggacgaatttggtataaccaattcggaaaaaatataaccgatgccatactaacaaaagaatttatgtctgcagaacctaaatatgatgtattagaaagtattgaagatcctattaccggtctaacttggcaaaaagtaaaactttctgtatggattggtaaaaatcaacttattgaaaatattgataatttatgggctgaagcggaaaaaatttataaaacacaatgcagtacttgtcatagacaacctgatgtaaaacattttgattcaaatacttggattgggctgtttaatggtatggtcggttttactaatattgataaaccaacaggaaaacgtgttttacgctatttgcagatgcattcatctgattttcaacggcacgataataatcattaatgaggaataaaactatgcaacaatcacgtcgtcaatttttgaaaaatatgtctgttatggctgcgacttttgcaatgcctaacttcctcgttgctaaaagtgcggtggaaaataaacaagatttatcacaatggaaaattaccggctcccattggggtgcaattcgtgccaaagtcgttaatggtcgagtaagtgaaattaaaccttttgagtatgatgaatacccaaccgagatgataaaaggaatcaaagggttaatttatagcgaatctcgcattcgctatccaatgatacgattagattggcttaaaaatagacacaacagcaatacagagcaacgaggagataatcgctttgtacgtgtgacgtgggacgaagcccttgacttattctatgaagagttagaacgaattcaacaaaattacggaccttgggctttgcatacgggtaacgtaggttggcgttcaacaggacaattccacagctgtggtaaccatatgatccgagcaatcggcatgcacggacacagtgtcagtactgctggagattactctaccggtgccggacaaattatcatgccttatgtgttaggctcaacagaggtttattctcaaggaacatcatgggagattttacttaaagagagtcaaaacatcattttttgggcaagcgatccggtaaaaaatttacaggtcggttggaactgtgaaacccatgaagcctataaatatttagcccaactcaaacaaaaagtagcagataattcaattaatgtaatttgtgttgatcctgtgaaaagcaagactcaaaattatctgggatgtaaacatcaatatatcaatccgcaaactgacgtgccttttatgctcgccatagcatatgtgctttatacggaaaatctttatgataagcagttcctcaaaatgtacactgtaggatttgaaaaattcgtaccttatttaacaggtgagtcagaagataaaacagcaaaaacccctgaatgggcagaaaaaatatgtggtatttctgcaaataaaattcgtgaatttgcacatttactggcaggcaaacgaactcaattgatttttggttgggccattcagcgtcaacaacacggtgagcaaccttactggatgggtgccgtcttagccgcaatgctcggacaaatcggtttaccaggtgggggaatcaattatgcctatcattatagttctatcggtatacctgaatcaggagccgccatgccgggctctttccctttgaacttggatgaaggacaaaaaccgaaatacgaaagcacggattataacggttatagtgcgatcattcctgtagctagattatctgattccttactaaatccgggtaaaacaatcgattttaatggacaaaaagtggtttatgctccatataaaatggcaatcttcagtggttgtaaccaatggcatcgtcattctgaacgcaataaaatgaagcaagcttttcaaaaactggaaaccatagtatcaattaattacagttggacagccacttgtcgtttttcagatattgtattaccagcctgtacgccttttgaacgtaatgatattgatgtttacggttcatatagtaaccgtggagtcattgctatgcaaaaattagtcgatccgctttacgattctcgttcagattttgaaattttcaaagaattatgtcgcagatttggtaaagagaaagaatattgtcgtaacatggatgaaatggaatgggtagaaaaactttacgaagactgtcgaaaagaaaatgaaggtaaatttgctatgccggcctttgaaaaattctggaaaacaggatttgtactttttccggaaggtaagccttgggtaagacatgcagacttccgagaagatcctgaacttcatgcaattggtacaccatcaggttttattgaaatttatagcaacaaaatcgcttcctacggttatgaagattgtaaaggtcatccaatgtggtttgaaaaaacggaacgttctcatggtggaccaaaatcagataaatttaaattttggttgcaatcagttcaccctgatcaacgtttacattcacaactttgtgaatcaaaagaattacgtgaaacttatactattcagggtagagaacctttatttatcaatccaaatgatgcaaaagaactaggcattgctcatggagatcttgtgcgagtttataatgatcgaggtcaagctattgtaggtgcacacctttcagaggactatccaagcggtgtagtgcggttacaagaaggtgcatggtattcaccgttagatgaaaaaatcggctctattgatacttatggcgatccgaatactatgactcttgacataggttcttctagcttagctcaagctgtttctgccaatacatgccttgttaatattgaaaaatataaaggcattgctcctgaacctaatggtttcaaaggtccaatagaaattgcattatgataacgttgaataccgaagaaaaaatctttatttattcatggcttaaaaatatattaagccatgagttaactgaacagcagctacaacaatatcaacaaggggtttttactcccttgtttgattttttgtcagaacaagatttggtggagcaaataaatactgtccgaaactcactcatgcaattatctaatttgcctttagctcatttagaattagctgcggattttgcccaacttttcttgttgaatggagaaaatagtgctttgccttacgcctccgcttacttatcggaaaaagaactaaatcaacatattgcatttattgaccatttactgtttaaataccagctaaagtttgatcacaatctacgtgaacccagcgatcatctcgctgtttatttagaattactgataacccttgaaaagagcggtcaaaaagagaaaagttttaactttattcaacattatttattagcttggcttattccttttaataaaaaagtacaaaaaattaaaacagaaacctcgttctaccaagccataacagaaatattaatcacgctgttaaataaaaatgtaaaactctcatagcatttaacaaaatcatcaacaaattagttagtgatttttatgctggatataaaaaagctaatcttaaaagattagcttttactttatttaatttgcctttcaatcacaccgccaccgagacatacctcaccttgataaaaaacagctgattgtcccggcgtaacagcaatttgtggctcatcaaaccgcacttcaacacaatcatcattgagaggaataacctcacaagctatatcttgttgacgataacgagttttgaccgtacaacgtaaattttgacgaattggcaggcaatcaacccaatatagctgagtagcaattaaaccttgtgataatagggcggaattatcatttccttgtgcaaccactaatacgttgttaattaaatctttttctaccacataaaaaggatcttcacttaaaccttttactccaccaatacctaatcctttacgttgacctaaggtgtaatacattaagccatcatgtttgccgatgactttaccgtcaaccatgcgaatttcacccggttgtgcaggtaaaaatcttgccaaaaattctttaaatttacgttctccaataaaacaaatccccgtagaatctttctttttcgctgtaaccaaaccgagatcttctgctatagcacgaacaatcggtttttcaatttcacctacaggaaatagactttgtgctacttgggctttgctcaaggtataaagaaaataactttgatctttattactatctagaccacgtaataattttgtttgtccatttacatcggctcgacgaacataatgtcctgttgcaatataatcagcccctaaatcttctaccgcatattccaagaaagccttaaatttaatttctttgttacataaaatatcaggatttggcgttcgtcccgctttgtattcagctaaaaaatgctcaaatacattatcccaatattcagcagcaaaattaattttatgtagctttattcctaatttatcacacactgcctgtgcatcagctaaatcgttagcggcagtacaataatccgtatcatcatcttcttcccaattcttcataaacaatccttcaacttgataaccttgctgttgaagaataaaagcggacacagaggaatcaacaccaccagacataccgcaaatcactttctttttactatttttagcaatttcaagtgcggtaagttttggtagttttttttcataaacaatggatttcatatttttatttatttttaataatcaagttaattttttattgaaggtaatttttagataaaaacataaatacgctttcatattgcgaggtgtttacatcaaacatctgtaaaaatctgtcagccgcttttctatctgcaatttctttttgaacaaatcgttcaaaatctttcttcaaactgtgggaaaaagattttctcatattaataaatttgactaataatgtatgagaataataaccttgctgaaaaatatcctttaaaatattgtcctgctcgatcattaatttgttaatattatcaaattgttcttcaataattttcttatcttctgtggaactaattttctctgaaattttccatttctcagccaaaatttcatctaacttaataaaattatactttattttttcagcatccttcactggtgcaataagtgtataacttgaaccatcaatctttatttcccttgggttagtcttcttttctacagcgaaaacaatagaaaaaatttgagaaattacaagtatcaaaaaaagtaattttttcacaaaagcttctccagataaaaaatatcaagaatattaacgttatttcaactcataaaactgcggttgttttttcgcaaatttttcttcatattcagtttttgcatcttcatcaccagcagcaagtttagcctgcaagttatcacatggagtatcacaatcacagacttttttcatccctaaagcagatataccaccacaacttccagcaatggacttacgttttatgatataaccaagagacatacctaaaataactaaaacaaaaatagcaaaagtgactaaaaataatttcatagaaactccttattttttctgagttgataatatttcagcaaatttagaggacattttattttcaaacccttgtggagttttgaccgttaaataaataggtaaatcattttgctcagcaatttccagtgctttttccgcacctaaaacaaataaacctgtggataagccgtctgcagtcatagcacttttagataagactgtaattgaggctaaattatgctgaacgggctggcaagttgtaggatctatttcatgggaaaaacgttttccatcttgctcaaaataattgcgataatccccagaagttgccatagccaaatcttgtaaaccgacaacttgtgatacagatcgagttccatcaaaggttggcttttcaatagctatttgccaagctttattttcagcattatgaccatttgctcgaatctcaccgccaatttccactaagtagtcagtaataccttgctcagcaatataatcagcaactttatcgacaccaaaacctttagcaatagaagataaatcaatataaatctgcggcacagatttgatcaaaaagaatttattgtctttttgtgttagtctaactttctcaatacctacccaggcttttcgttcagctatttgctccggtgtgggtgctttttctacccgtttttccggtccaaaaccccataagttcacaataggaccaactgttacatctagagcaccttgagtaatttgatttaactttattgcttcagcaactacaaaagccaaatctgcggaaatttcaataggattatttatctccttgtttttgttgaacacacttaactctgaattaggaatataagtggacattttagcatttacatcttgtaagataccttcaatgccttcgtgcattttttgtacacttaacttagtcttgccattatcaatatatttgatatggtaagttgtacccatggttctaccatttaatgacactaactcagcttctttttggcaagcactaagtaaaaataccaacgcaaatacgtttattaaatttaataataatttcttagtcataaagtgcggttcatcctatttataagtttttactaaaggtttatcagcctttttaatatcaatatgacaatagccattaggattttttaataaataatcctgatggtattcttccgctggatcaaatcgttgtaaaggtaacacctcaacaacaattggtttactgtattttttctgttcttgtgtaagagcggttaaaataatttctctatcctgtggatcggtatagtaaatacctgttctatattgtgttcctttatcattaccttgttgatttaaactagtaggatcaattactcggaaataatattgcaaaatatcctctaaacttaatttattttgctcatagatcactttaaccgtttccgcatgaccagtattattgtataacacatcttggtaacttggattttcagttttaccatttgcataacctgaaatagcatccagcacaccatcaatacgatgaaaatagcactctactccccaaaaacaacctcccgcaagataaatagctttgttgctcatacgtaatttcctttatgcaagtataattagtttaaataaaatacaaagcggtcagcttcaaaaatttatgaaatctgaccgcactttattgatcatttaagatcagccaccaaaatcatctaataagatattttcatcttcaacaccaagatcttttaacatcttaattacagcagcattcatcactggaggtccacacatataatattcacaatcttccggtgcttcatgatttttcaagtagttttcataaagaacattatgaataaagcctgtgtaaccatcccaattatcttcaggaagtggatcagaaagagccacatgccatacaaagttatcattttcggcttgaagcatatcaaaatcttctacatagaacatttcacgtttagaacgagcaccataccaaaatgacattttacgttttgattttaaacgttttaattgatcaaaaatatgtgatctcattggtgccatacccgcacccccaccgataaagaccatctcattatcagtttctttagcaaaaaattcaccaaatggacctgaaatagtaactttatcatcttctttcaaagaccaaatgtaagaagacatttgacctggcggtacatcaggattacgtggtggaggtgttgcaatacgaacatttagcattatgatacctttctcttctggatatgaagccatagagtaagcacgaataatatgctcgtccacttttgaagtataacgccataaatcaaatttatcccaatcttcgtggtattcttttggaatatcaaaatctttatagtgaacagtgtgtggttctgcttcaatttggatgtaaccaccagcacggaatggtacttcttcaccttcaggtatttgaagtttaagctctttgataaaagttgccttattgtcattagaaataacagtacattcccattttttcacaccaaaaacttcttctggtaactcaatcttcatactgttcttcacatttacttgacaagaaagacgataaccttctttagcttcacgctttgaaatatgtgaaagttctgtcggcagaatatctcctccaccttcagtaactttcacgatacattgaccacaagaaccaccgcccccacaagcagaggatacaaagatacctttatttgccaatgcacctaataatttaccacctgctggtaagttaatagctttaccaggatcatcattaatttcaatagtaatgtcccctgaatttaccaatttagatttagcaaacaaaataagtacagctaaagctaaaacgataacagtaaacattgcaataccaagagtaatttccatttaagtatcccctattacaactgaacaccggaaaatgacataaacccaagagccattaagccaacagtgatgaaagtaatacctaacccacgaagacctgccggaacatcagcatatttcattttctctgtaataccggcaagagcaactatagctaacatccaaccggtccctgcaccaataccataaacaacagactcggcaaagttatagtcacgctgaaccataaaagataccccaccaaagattgcacagtttaccgtaattaaaggaaggaaaatccctaatgcgttataaagtgcggggaaatatttgtctaaaatcatttcaagaatttgaactaatgcagcaattaccccaatgaaagtgatgaaatttaagaaacttaaatcaacaccatcaattaaagctccatctttaagaatgagagaataaaccaattgatttacaggcacagaaatacctaatacaacagtcaccgcaacacctaaaccaaaagctgttgatactttctttgaaactgcaaggaatgtacacataccaaggaagaaagaaagagccatgttttcgataaatacggattttacgaaaaggctaatataatgttccataaattatttctccacctgttccggtttccatgttctcagaccccaaataatgaaaccgataataaagaatgcacttggtgctaataagaataaaccattggtttgataccatccaccatcttggatagtttgaaaaatagtcataccaaataatttacctgaaccaattaattctcgaataaaagcgacagtaactaaaattgctccatagcctaaaccattaccaataccgtcaacaaaactttctattggtgcagatttcattgcaaaagcctccgcacgtcccatcacgatacagtttgtgataatcaaccccacaaaaactgaaagttgttttgataacccataagcatacgcacgtaaaatttgatcaaccaaaattactaacgaagcaataattgccatttggacaattatacgaatactgttcggaatataattacggattaaagaaataaaaaagcttgaaaaagctgtaacaagacttaccgcaattgccataacaactgctgtttcaagtttggttgttaccgccaacgcagaacaaatacctaaaatttgtaatgcaatcggattattatcagtaatcggtgataataataactttttaatatttgcatttgccattagttagcccccttttttagttttgctaaatatggaccaaagccattagcaccaaaccaataatcaaacgtaccttgaactcctttagaagttaatgttgcaccggaaagactatcaattccatgttgtgcatcagacgatgcacctttacctacacgaatagccggttgattttcttcatcaagcagtaatttaccaacaaatttagcttgccattttggattttcaatttcgcctcccaacccaggtgtttcaccatggtcatagaatgtaatacctttaattgtattaccatccggttgaattgaaacaaaaccatacattaccgaccacaaacccgtaccatacacaggtaaaacaatttggtttatctgattgttctcatctttaacaagataaacttccgctaatttagcacgttgacgtaaaccagctttatcatcttgaggggcaatagaaacattttgagcggaatctttcgctgcagattttgcatcaaaaccggtaggacattttacataatcaccagaatttaattccacacaacgagcttcaatattcttagtaaaaatatccttaatttgaccggtttttgtatctttttgcaacaatcctgcaacacttaaaatatttttttgcttatcaagttgtttttgttcttcttgtgttggttttaacaataccgcagaaccagcaacaataatagaacaagctaaactcaacagaacaacaatcgaaattgttcctccaacactatctttattaaatttagccattgcgagatctccgacgtttaatatttgcttgaacaacaaggtagtcaaataacggtgcgaataaattagcaaataaaatagccagcatcataccttcaggatatgctggatttgccacacggataattacagccatcacaccaattaatgcaccatataaccatttacctttattagtaaatgcggctgaaacaggatctgttgccataaaaaacatacctaatgcaaaaccgcctaatacaaaatgccaataccattgcattgcaaataatggattagtttcagatccaataatattgaataaagttgaagttgcaatcataccaatcatcacaccagcaatgatccgccaagaagcaattcgagcaaaaacgataattgcagctccaattaataaagcaaaagtagaaacctcacctatagaacctggaatattacctaaaaaagcatccatccaagtaataggctcgcctgttgcaacatgttttaatgcaacttgtccacctgcagcccattgagaaagtgcggtcgcaccagagaagctatccgcagctgtccaaaccaagtctccagaaatttgagctgggtaagcaaaaaataaaaacgctcgacctgctaatgctggattcatgaaattcttaccaacaccgccaaacacttcttttgcaacgacaacaccaaaggttgttgccaatgccgcttgccataatggtaatgtagggggaacaatcaatgctaataaaatagatgtaacaaagaaaccttcattaatttcatgtttacgcaccattgcaaataaaacttcccaaaatccaccgaccaaaaagacagttatgtaaattggtaaaaagaaaattgcacctaatgccattttagctaaaacaccagcatcaatagacactaaaccaagcatgtttgctaatgcaaagtgccaatcattagctacattttgagctaagtttgcagaaaaatcaccaacacttaatgcaagaattgattgtgcaccaacattatacattccgtaaaacattgcagggaataatgcaagccaaacaagcaccatcatacgttttgagtccaatgcatcacgaacatgtgaagatttacctgttactgtacccggcgtatataaaaatgtcgctgtcgcttcgaacaatgcataccatttttcatatttaccacccggcaaaaaagcaggttccattttctctaaaagatgttttaaacccatttttaaccttccttctcgatcttatctaatgctgcacgtaacatcggaccatattcatttttacccggacaaacgaaagtacataaagccaaatcttcttcatccaattcaagacagcctaaagcctgtgcactatccgtatcacctgatgctaaatcacgtaataataatgtaggtataatatctagaggaacaacacgctcatatgcaccaatcggtaccatagcacgatggccaccatttactgcggaagtaaaattaaataatttactgctgaaatgtcctagtactgttcgagtaatggaaaatttgttttttccaggcataatccagcctaaaaattctttctcacgaccttcagcaataacagatacttgcaaagcataacgtcccaaatagttatatggaccgattgctgtattaccacttaacactgaaccggaaataactcgattttcacccgcacttaattcattttccgttaaatgtgaaagatttgcacctaactgcgtacgaattaaacgaggatttttaacttgtggtccagctaaagaaaccactcggtcagtataaattttgcctgtagtaaataatttaccaatagctataacatcttgataattcaaataccaaactgatttagttgcactaacaggatcaataaaatgtatatgtgtaccacttaatcctgctggatgtggtccactaaaatcatgaacagctaagttaggtaaatcaatcgttgggatattgctatcaccagctttacacaaatgtaatttgccttcatgtaaacgacttaaaacggttaatccatcagtaaaatcctgccaatgttcttttaacacaatttcaggatttgctgataatggatttgtatccattgcattaacaaaaatagaagaaggtactgcatcactcgcaggtactttactgaaaggacgcgtacgaagtgcggtccataaaccagaagattgtaaattttgacgaacttgctctgaagtcaattttttcaattcatcttcattatattgagtaaaggtaatttgttcattaccttccactttaattaccacagattgtaaaattcgcttagcaccacgattaatcgcagttacagtaccacttgcaggtgcagtaaatacaataccaggattttttttgtcttcaaaaagtacctgaccttttttcactacatcaccttcacgcaccttcatcgaaggtcgcatacccacatactcttcgccaagcaaagcaacttctttaacagcattgccgttatggattacttgttctggttttcctgcaataggaagatccaagccttttttaattgtaatcatattgtttgcactacttttcgttagattaaaatatagttgtaacaaaaaagtaacaaccgcgtcttgagtaatgatttcagccgacgaactactaaaaatcaatttatccgcatcaatcacataaaaataaaactcaaattctgttttttactgtacctagcttaatgatagaaacaataaattaaaaatttactaaaaatcaacgagtcattttaactaaataatgactccgattccactttagacacctttttttatgattttttatgaattttttgatctatttttgtaaaaaaatcaattctaaatcaaaatattgctaaagagttactgaccaatacctgaacaattaggcgactttggaaaaactttgcctaatttttcccattcttcaggactatataaatgtaaagctaaagcatgaataccttgttgtaactcactactaaacaatgaataaactaaacgatgacgagcgacttttgtcaaggatgaaaacctattgctcacaacaactaatttaaaatgagagttagcacctcgacctgagctgtgcatataactttcattttctatctgtaaaaagtgcggtgaaaattcttgtaatagctttttttctaggactttttgtatcgacataaatttatccttatttttactatttgatatttgatatataacactatattttcattaataaaaaacagattttatttttatcttacatcaaaaatagatttttttattactcaactctgtttttttattgcatactctttcattacatcaacaaaaaaccgccttttggcggttttttatttataagattaacgttttctttgtgttaaacgatctgttaattcataagcacgtaattttgccaattctcttgaaagtttagataccaacatttcataattagcatctttggcactagaaacaatattttgttcagccttacgtttcgcctccaaaatacgttctctatcaagttccttaccacgaatagcaacatcagctaaaacagttacaactgttggttgaacctccaaaaaacctcctgaaatgtaaataacttcctcagtatcatcttcaagagtaatttttataatacccggcttgatagcggtaagtaagggtaaatgtccggctaaaatacccaactcaccttcagaacctgtagcttgaatgcctttaacttcaccatcaaaaatatgttgttctgcacttactacgattaatttaaatgtcgccatctttttctccttcaagtttgctgttaatcagtcttgaagtaactacatttttttggctttttctagcacttcttcgattgagccaaccatatagaacgcttgttccggtatatgatcgtattcaccatctaaaatacctttgaaaccacgaatagtatcttttagtgatacatatttaccaggagaaccagtaaatacttctgcaacaaagaacggttgtgacaagaaacgttctattttacgtgctcgtgctaccactagtttatcatcttcggaaagctcatccataccgaggatagcaataatatcctttaattctttatagcgttgcaaaataccctgcacacctcgagctacatcataatgttcctgtcctactactaatggatctaattgacgtgaagtagaatccaaaggatcaacagctggataaatacccaaagaagcgatattacgacttaacaccactgttgaatccaaatgagcaaaggttgttgccggagaagggtctgtcaagtcatccgccggaacataaacagcctgaacggaagtaatagaacccgtttttgttgaagtaatacgctcttgtaaaacacccatttcttctgctaatgtcggttgataacctaccgcagaaggcatacgacctaaaagagcggatacttctgtacctgccaaggtataacgatagatattatctacgaaaaataatacatcacgaccttcatcacggaatttttccgccatagtcaatcctgttaaagcaacacgtaaacggttacccggcggttcattcatttgaccataaaccaacgatactttatctaatacattagattctgtcatttcatggtagaaatcattaccctctcgagtacgctcacctacacctgcaaacacggaataacccgagtgttcgatcgcaatattacggattaattccatcatatttacggttttacctacacctgcaccaccaaataaacctactttaccccctttagcgaaaggacaaattaagtcaataactttgattcccgtttctaaaagttctgtactgttcgattgttcttcatagcttggtgccgcacggtgaatagcccaatattcttccgcaccaatctctcctttttcatcgataggttctcctagtacgttcataatacgtcctaaggtttttgttcctaccggaacagaaattggatttcctgtattttctacttttaaaccacgttttagaccatcagatgaacccaatgcgatacaacgtactacaccgccacccaactgttgttgaacttcaagaattaatcctgattcaacttttaatgcatcataaacttttggtactgcattttgtgggaattcaacatcaattaccgcaccgataatctgtataatttttcctgctgacattaccttatctccattaaattgctgctgcacccgcaacaatttcattcaattcatttgtaatacttgcttgacgagctttattatacaccaactgcaagtcattaattaaattacctgcattatctgttgctgctttcattgctaccattctagcggcctgctcagaagccaaattttcaacaaccgcttgataaacttgagattccaaataacggactaataaactatccaacaaagtttgaggatttggttcgtaaatgtattcccaattatcactatttttgcctaagctatcattatctaattccggtaatggaacgagtttttccattattggtttttgcgacatcgtattgataaacttattataagtaacatagattgcatcaattttaccttctttataagcctcaaacatacgatttgctataccaattaattcttcagctacaggggtatctcccatacctgaatgctgagctttaatatttaaaccaagagattggaaaaaacctataccttttgctccaattaaacctaatgaaacttcaacattttgttctttccagttttttatttcagaaagtgcggtcttaaataaattaacatttaaaccgccacataaacctctatcggttgaaataattaagatgccaacgtttttaacttctcgttcaatcaaaaatggatgttgataatcaatattggcttttgatatatggctaattacaccttgtattgctttagaatacggacgtgaagacgacatacgatcttgcgttttacgcattttcgatgctgcaaccatttccattgctttagtaattttttgcgtactttgcacactggatattttggttcttatctcttttgcaccagccattttatttctccgttaattaactattaccatgcaacatttgctttaaattgatctaaaacggtcttcaatgtatttttaatttcatcatcataattaccagttttagtcaactcagccataaaatcagcatagttgtagtttgcatattctaaaagtgcggtttcaaaagtacctatacgatttaattcaacgtcatctaaataaccaaattcaacagcaaataataccagagcctgttcagcaacacttaacggtgaatactgtttctgtttcaataattcagttactttttgtccatgtgataattgtttacgtgtagcttcatcgagatctgatgcaaattgagcaaaggcagctaattcacgatattgagcaagtgcggtacgaataccaccagccaattttttaactactttggtttgtgccgcaccacctacacgagaaaccgaaatacccggattcactgcgggacgaatacccgaattaaataaattggattccaagaaaatctgaccatccgtaattgaaattacattagttgggacaaatgctgaaacatctcctgcttgagtttcaatgataggaagagcggttaaagaacctgtttttcctttcacttcaccttttgtgaatttttctacatattcttcactcacacgagaagctcgttcaagtaaacgagaatgaagatagaacacatctcccggaaaagcttcccgacccggtggacgacgtaaaagtaatgaaatttgacggtaagcaactgcttgtttagataaatcatcgtaaacaattaacgcatcttcaccacgatcacggaaatattcacccattgcacaacctgaatatggagcaaggtattgtaaagctgctgactcagatgcagaagctacaacaacaatagtattttgtaatgctccatgttcttctaatttacgtactacgttagcaattgttgatgctttttgaccaatagcgacatatatacattttatacctgaatcacgctgattaatgatggcatcaatagccaatgctgttttacctgtttgacggtcaccgataattaattcacgttgaccacgaccaataggaaccattgagtcaacagccttatagccagtttgtacaggttgatcaacagatttacgttcaattacacccggtgcgataacttctaccggtgaaaaaccatcatttttgatttcacctttaccatcaattggctgtccaagggtatttactactctacctaataaccctcgaccgaccggtacttcaagaatacgacctgtacactgaacttccataccttccgctaaatcagagtaaggtcccatcactaccgcacctacagaatcacgttcaaggttaagtgccatggcataacgattacccggtaatgcaatcatttctccttgcatcacatcacttaaaccatgtatacgaataattccgtcacttacagaaacaattgtccctgtattacgtgcttcgtttatcacctcaaactgagctatacgttttttaatcaattcactaatttctgtcgaatttagttgcatattttattcctcttacaatcgcaactcatttgctagacggttgatttgtccacgacaactaccatcaataacaaaatcatttgtacgaataatagctcctgcaattaacgaactatctattctgcaatttaatattactttacgagcaagtcttttttccattgcggtaataattttctgttgctgtgcatcatttaactgttgagcagaaataacttcaacttgtgatagagatttatattcttcaacataagatttaaactcgttaaatacagctggaagtacagctaaacgcttattttcagccatcaacctaactaaattttgcccatattgatcaagttgttcgccacaaattgagatcacagtatcagcaagtttaaaagtagaactagtgcttgttaagtaagtttgaactttatcatgacgaataagctcagacaaaaactctaacatattagtccatttttctaccgcacttttatctttttcagactgctctactgcaaaatcaaataccgctttcgcataggggcgagctatcgtagttaattccgacatagtctcaaccttcctataaatctgcaactaatttatcaataatgtcattgttcgccgcttcatcaatgttgcgacccacaattttctcagcaccggcaatagcgagagatgcgactttaatacgcaactcttcttgaacacgtttacgttcagattctatttctgcatgtccctgttcaataattttctctcttaatgcctcagcttcaattttgacttcttccaaaatttcattgcgacgtttattcgctagatccactatttcctgagccttaattctagcttgattaatttcttgctcaactaaaacctttgtatcggattgctcttttttagcagcttcagccgaagctagtgcatttgcaatagatctttgacgttcttctatggctttaataatcggtggccatacatatttcatacagaaccacacaaaaatagcaaaagcaatcagctgacctattaatgttgcatttaagttcacaatgccctccctaaaattggatttattcttctaaagaataatatgattatttatccaactttaattagtttaataaaccaatgaatggatttgcaaaaataaatagtaatgcaatacctactgcaatcattgaaatagcatctaaaagaccagctacaataaacatttttgtttgcaagctagctgctaattcaggttgacgagcagatgattctaagaatttaccgcctaaaagactaaaacctatagcagtaccaagtgcagcagctgctaataaaattacagaaccaaaaatagttgcagtaataatgttttccataatattctcctatagatgtagataaaagtttagccaaaagctaagttgttaaaaaatcaatcgaaaatgtctagtaaaaataatttcataaaacagatttaatgatctgatttattataagctatacttagatatactacagtcagcatcataaaaataaatgcctgtaaagtaataactagaatatgaaaaatagcccaaattaaatgcaaaggaatacctaatacttgcggaataatattatctgccatatacataacagcaataaggacaaaaataagctcccctgcgtacatattaccgaataaacggaaggctaatgaaataggcttagccaaaagggtgactgcttccaataaaaagtttacaggaataaatgcccaatggttgaatggatgtaaggtatattcttttacaaaaccacctaaccctttagacttaatcgtgtaaaaaataattaatgcaaacacacaaacagacatacctaatgtcgcactaatatcggctgtaggaactgctcgtaaataatgaatacctaataactcggcaaactgcggcggaaaatcaacaggaatcaaatcaatagcattcataataaacacccaacagaatattgttaatgccaatgatccaatttgatgacgaacatcacttccgtgaatattatctttaacaacaccatcaacccactcaactagcatttcaactaaacattgaaattttccgggaactcctgatgttgctttactagcaatacgatagaaaaagaaaaggaacaaaactccagatactaaagaaaaaaataaagtatcaagatggacattccaaaaaccttgtccagtagttaagaatgttaaatggtgactaatatagtcagcagtagtatggccagccatagttaatcctttttaaaactaaattttaaggtatttatttaccataaaaggcaaaagattattcaatacaatacttataagataacctacaaaaaaaactttaaaatcaaccttaaatgttttaaaaatgaatacaatcaaaataattgttaagataaacttaatcaattctccactataaaacatttttaggttatttttatactttttgttagtaaaaaacattaaatacacaaaaaggcaatatggaataaaaactgaaagtgcaccaaataagaaagataagtacacttcatgatcactcataccgcctatactcagtaaaacaaaagaaaacataaaaataaaaaactcaattaataatgaaattttatatcttttttgagttttttttattacagcagacatcttatcgttctaatttgctacttacaaaaatcttgccagttacaagcctatttttgcgaatttttaacttaaaatcattttataaatgacagtttcgaccatattataaataattcattaaatttattctaatcttttttaacaaaactaaatgacgcttaccaactaattcaggaacattcaattctatgattttatccacagaaaattgagcagataaagccgaaacttcttccatattatattgaccttttaaagcataaaaaaaaccttgatccgttagtaaatgttgacaccattccgtcatatcttttaaagatgcaaaagctctacttaaaaccccatcaaattgatgatcaggtttaaattcttcaactcgacttaaaacaggttcaacattagttaattcaagttcacgaactgcattacgaatgaaactaatacgtttaccgagactatccaataaaaaaaactttttgtcagggttaattatagctaaaggtaatccaggtaatcctggaccagttccaacatcaataaaaatatttccttgtaaataaggactcacaacaatactatccaaaatatgctttaccaacatttccataggatcacgcacagatgttaggttataagccttattccatttgtttaataataaaaccagctgaactaaccgctctttttgtaaattagtgggtaaaagagcggtattttttaaaaaaaaatttagtttttccattaaattcttttgtaaatcagccattattcacctcttttcagcataccttgtttttttaaattaacgagtaaaatagaaatagctgcaggcgtaatacctgaaattcgactcgcttgaccaatagaaattgggcggtattgttctagcttagcacaaacttcattggataatcccgatatatttttataatcaaaattagcaggaatagccgtattttcatggcgtttttgacgctcaatttcttcttgttgatgttcaatataaccttgatatttaattacaatttcaacttgttcaacagcttctttgtcttccattgccggtttaaaaggagtaagtgcggtcaaaatttgataatttatttcaggacgacgtaataaatcttccccatttacttcacggacaagtgggctttttaatatttcattagcctcatttaaatattcagaacgaggatgcaaccagattgaacgcaaacgttgacgttccagttcaatattttccattttttgattaaatcttgcccagcgaatatcatcaattaatcctaattctcttgcaattgaagttaaacgaatatcagcattatcttcacgcaacaataagcgatattctgctcttgaagtaaatactctataaggttctttagttcctacagtacaaagatcatcaaccaaaacacctatataggcttgatctctacgaggaaaccaactttctttttcttgaacaaataaacctgcattaataccagctaataaaccctgtgcagcagcttcttcatagcccgttgtaccattaatttgaccagcaaaaaataaaccagaaatagcttttatttccaaagttggttttaagtctcttggatcaaaataatcatattcaattgcataacctggtttaacaattcttgctttctctaatcctttcattgaattaacaattttcatttgaacatcaaacggcaaacttgttgaaataccatttggataaacttcattacttgttaaaccttccggttctaaataaatttgatgagaattacgatcagaaaaacgtattactttatcttcaatagatgggcaatagcgtggtccaataccttcaataactcctgtatacataggactacgatctaaatttttgcgaatcacatcatgcgtttgatcattggtatgcgttatatagcaaggaatttgctccggatgttgttctacagatcccataaaagaaaaaacaggtaatttttcatcgccatattgtttagctagaatatcaaaattaatagtacgagcatcgatcctcggcggcgttcctgtttttaagcgatttactcttaaatttagatccctaagttttttagcaagatttacagatgcaggatcacctgctcgaccaccagcatagttttctaatcctatatggatcttaccggctaaaaatgtacctgcagttaatactactgactttgccctaaattttaatcccatttttgtttcaacacctgtaactctatctttttctaaaataatatcggttacttcttgttgaaaaatatctagattaggttgattttcaagagcaatacgtacaacttggcggtaaagaacacgatctgcttgagctcgtgtagctctcacagcaggacctttgctactatttaaagtgcgaaattggatacctgctttatctgcagctgttgccattaatccgcccatagcatcaatttcttttactaaatgtcccttacctattccaccaatggccggattacaagacatttgtcctaaagtatctatattatgagttaataaaagcgtttttagtttcatacgagctgtcgctaaagcagcttctgttcccgcatgcccaccaccgattacaatgacatcgtaattttctgtataaaacataatagtctaagtgttattaaaggttttagagttcaaaatagcgatctattctacattaaattacaagataaacaaaaagaagaaagaagtaaaagatcatcagttgatcttcttcctaatataaatagaatctttttatatataaaagtattattatgtatattattaggatctttttttttgttaataagtgtttttttattttttaaaataataagttggatcttttttttattgttatgatctagatcgtttacagtaaaaaatctgtggatatttttatattttatccacaaattttttttaataaaaaacttttttatcttaataacaggaaattttttgttttttattaaagttatccacagagtaatgtaaattaattgaataaatttagattaacattttttaaccagttttcagcaaaatgatcaggatcatcaacattcatgacatctatttttaaactttctgtaatttttacagcttttttattcagtaaaatgtcttcaatttgattcacagcatagcaaaaagtatcataatcggagcttcctaaaccaataacagcaaaacgtatttgagaaagatctaagtttttttgtgtaatttcttcaaataggggttttaagttatcaggtagttcaccggaaccatgagttgaactcactattaaccaatttttatgtttaattacatcatttagtgaaggaccatgtaatagattagtcgatacacctttcttatctagtaagaattgaatatgttcggctacgtattctgcacctcctaaagtacttcctgttagaatgcaaatttgtttattcatcttaataccttaattttagttaaaaaaataggcttagaattaatctaagccattgattttatgaatttaaatattatcaatacgacccaataatgaacgtaatcgttcttgccagttatgatgttctttttttaagtgttcattttcgctacgtaattgttcattggtttgacgagatagctcatttttttcttttaattcttcaatttctaattgaagtaattggattgtttcaacagcttgtttaattttttcttctaattggtctaaaatttctaaagacatgatgatttccttttaaataaaactaatttgcgtagttattttaactcagttgtctattatttttaaggaaatttatgaaaaatttatatgttgtatggcattgtgcaatcaatccattatttgtaatagaaaatataccgctctttatgttttattggagtataacatcagcagtaagttgataaaaattagcctattaagcaaatttttgctataatccgagccaatttttatttataaaaaagagaaattttatgtcagaaaatacaactgaaaattatggtgcaggaagcattaaagttttaaaagggcttgaagcagtacgtacacgacctggaatgtatattggtgatactgatgacggtacaggcttacaccatatggtttttgaagttgtagataatgcaattgatgaagctttagcaggttattgtaaagatattattgttactattcatgcagataactctgtctctgtgcaagatgatggacgtggtattcctgttgatattcatcctgaagaaggtgtttcagcagcacaggttattatgacagtattgcatgctggtggaaaatttgatgataactcctacaaagtttcaggaggattgcatggagtagggatttctgttgtgaatgccttgtcggataaattacaactcactattcgccgtcaaggaaaagtgcatgaacaattttaccatttaggtgatcctcaggaacctttatccgttattggtgaaacggaaaaaacaggtacaactgtacgcttttggcctagtcccactatttttactaatattgattttgaatacgaaattttggcaaaacgtttacgtgaactttcatttttaaattcaggtgtatcaataaaattattggataagcggaatgatcgtcaagatcattttcactacgagggcggtattaaggcttttgttgaatacttaaataaaaataagacaccaattcatcaaaaaatattttattttagtgcggaaaaagacgatattggtgtagaagtagctttacagtggaatgatagttatcaagaaaatgtttattgtttcactaataatattccacaacgagacggaggtactcatttagctggttttcgtggtgcattaactagggttttaaacaaatatgtagaagaaaattcgaataaaaaagacaaaaaggatatagcaacttcaggtgatgatgcgagagaagggttggttgctattgtttctgttaaagtaccggatccaaaattttcttcacaaacaaaagataaacttgtgtcttctgaagtaagagctccagtcgagtctgttatgagtgattatttacaagaatttttggaagaaaatccaaatgatgccaaaattattgtaatgaaaattattgaagctgctcgggcaagagaagccgctcgcaaagctcgtgaaatgacacgtagaaaaggtgctttggatatagcaggtcttccaggaaaattagctgattgtcaggaacgtgatcctgctttatctgaattatatcttgtagagggtgattcagcgggaggttctgctaaacaaggacgtaatcgtcaaaatcaggctattttgccattaaaaggaaaaatacttaatgtagaaaaagctcgctttgataaaatgttatcttctcaagaagtgggaactttaataaccgcacttggttgtggtataggcagagatgaatataatcctgataaattacgttatcatagtattattattatgaccgatgcagatgtagatggttctcatattcgtacattgttattgactttcttttatcgtcaattaccggaattaattgaacgtggtcatgtttatattgcacaacctcctttatataaagtgaaaaaaggtaaacaagagcaatacattaaagatgatgaagaaatgcaacagtttgagttaaatttggcattagaaggatcctctctttatgtaaatgaaaatgctcctgcaatgaacggaatagcattagaaaaacttatttcggaatataattcagtacaaaagatgattagccgtttatcttttcattatccagaaatattattgaaatcattaatttatcaaaaagcattaactaatgaaatgatgattgatgaaagtgcggttgatttttgggctaaatctttagttaatattttaactgacaaaaaaataagtggtagtagttacaaatatcgtattgtttttaacaatgaacgtcatttatatgaagtagttatcattattcgtacccatggtatagaaaaaaattattttttgaattttgaatttttaaatggaactgaatatagccgtattgttaaattaggtaaccaactacagggtttattagaaaaaggagcttatgtatctcgtggtgaacgtcaacaatcggtttcgtcttttgaacaagctatcgaatggctgacgaaagaatctcgccgaggtctgattattcaacgctataaagggctaggagaaatgaattcagatcagttatttgaaacaactatggatccaaataagcgtacaatgttaaaagtatcgattaaagatgctgttgcagcggatcaattatttaccactttaatgggagatgaagtagaacctcgacgtgaatttattgaaatgaatgcactaagagctaatttagatatttaattttattttttatttatcaattttggaattaatagaggtttttaatgtgtacagttatgcagaaagatgtattaattgaaatggttgctaatactatggctacgatcgatgtaagaacagaacctaatgcagaggataatgaggatcagaattatttgatgaacttaagaaatgatttgtatagtactcatcatgatgacattgattataatctcctatcaatgacagtaaaaaatatcaaaaataaatatataggtcagcctgttcataaatattatgcgtaggtgataagcataataaataagctcttgatttgtgtgaatattatttgtaaataaaaagatccccttaaaaagggggatctttatttttttgttgttctaaaaaattgatgttctttaattaacgcaagaaagggttgagcaaaacgttttaatttaatatcgccgacaccattaatttgtatcatttcttgttctgttattggttggtattgtgccatttcttgtaatgttgcatcgttaaatactatataaggaggaatattttctttgtctgctatttttttacgcaaaaaacgtaatcgagcaaagagatctttatcgtaatttgtgaccgctcttttgggtatagtaacggcattagtaatagaagatatccttggtgttgctaatttcaatggttgttcacctcgtaaaataggtaatgcctctaatgtgagttgtaatgttatattaaaatggtcaattacttgttttatcagacctaaatggattaattgtcgaataactgattgccaatattctctactacgatctttaccaatgccgaaaacgcttagtttatcatgttgatattctttaattttttgattttgggaaccacgcagtacagcaataatatacattgccccgaaacgttgccccactcgatagattgctgacattactttttgtgcatcaaccaatccatcatattttttcggaggatctaagcaaatatcacagttattacaaggtttttgttgatattcgccaaagtaatttaatagaactaaacgccgacaaatttggctttcagcaaattctcctatggattgtaatttatgtagttctatttgacgttgtggtatctctggtttttctaaaagtactttttgtaaccaagcgtaatctgcaggttcgtaaaataagacagcttcagctggtaaatcatctcgccccgctcgtcctgtttcctgatagtatgcctcgatacttcgaggtagatcaaaatgagcgacgaaacgcacgttagatttattaattcccattccaaaagcaattgttgcaacaacaatttgtacattatcatgttgaaaagcacgttgaacaaattctcgttgctcattactcatgccagcatgataagcttcagctgatattcctttttggcgtagactttctgcaattcgttcaaccttattacgactgttacaataaataattccacttttccctttttgttttgcgataaattgagaaagttgctccataggtttaaatttttcaactaaggagtaacggatatttggacgatcaaaactaccgatataaatatggggattagataatttaagatgaataaggatatcttgtcgggttgcctgatctgctgttgcagttagtgccattattggagcatcaggaaaacttgctttcaatcctcccaattgagtatattctgggcgaaaatcatgtccccactgtgaaatacaatgggtttcatcaacggcaataaaactgactttgcaatgagaaataaaatgaaaaaagctggttgttaaggctttttctggagatatataaagcaactttaattttcctgatattgctttattttgaaccaactgttgttgttcaaatgtttgactggaatttaaataatcagcatttataccatttgctaataactgatctacttggtctttcattaatgaaattagaggagaaatcactaaagttaaaccggagaaacaaagagcgggaatttgatagcataaggactttccgccacctgttgccataataactaaactgtcctttttagctaaagttgcttcgataacttccagttgtcctttacggaaggactgatacccaaaaacagaatgtaaaatatcaagtgcggtagatttttccacagaatcttggctaaaatctaccgcacttttttgttgcttccattcttcaactgacattaagaaaaactcacctgttcaccatgagccaaacaagcttgttctaaacattgccaaaacaattttccatcctgagcaatccattgattatttttaaaggcaaaatgaaaacctccagccttgcttgcaagccataattctaataatggttcttgtttatttacaacaatttggctacgatcagcgaaagtaatagtaaaaaccgaaccttgagtatcacaatctacatcacaaccttgttcttctaattgttcttctatttgcaaccaaacttgttcgatattttggtgatattctgctatgttcatgaagtttacctatcaataaaaaagaataacaaaagattataaagatttttataagatagtgatagcacaaaggcatttttaatggtaaaaagtgcaagttttttaattaacaaggacataagcaatgaaaaaaataatttcaattttattacttagtgcaatagcttttggtgtgtcaggttgtggtgttaaaggatcattatattttccagaaacagaacaaaatcaacaaaaagttaattcaaaattaaagtaatcaatatgtaaggataacattatggatttttttctatataaagatggacacttaatggcagaaaatgtctctgtgaaaaaaattgcagagcaatttggcacgcctgcttatatttattcacgagcaactctagagcgtcattggtatgcttttgataatgctttaggagatcaccctcatttaatttgttttgccgttaaatccaatcctaatatagccattttaaatattatggcaaagttgggatcaggttttgatattgtgtctcaaggtgaacttgagcgagtattatttgctggaggtgatcctaaaaaagtggttttttctggtgtggcaaaatcagaacaagaaattgcacgtgcattggaagtaggtattcgctgttttaatgtggaaagtgcggctgaattaataagaataaatcaggttgcaagaaaaatggggaaaattgcctctatttctttgcgagtaaatcctgatgttgatgctcatactcatccttatatttcgactggtctaaaagaaaataaattcggtgtaagtgttgaacaggctcgagaagtttatcgccaagcaagtcaattggaaaatataaaaattgtaggaatagattgccatattggttcacaactgacagaacttcaaccttttttagatgctacagatcgtttaattgttcttatggagcaattaaaaaaagatggaataacattagaacacgtggatttaggcggtggtttaggggtaacttatagtgatgagaaagcaccacatccaagtgaatatgctacagctttgctggaaaaattaaaaaattatcaagatttggaaattattttggagcccggtagggcaattaccgcaaatgcaggtattttactcactagagtggaatatataaagagtaatgaaagtcgccattttgccatcgttgatacaggaatgaatgatatgatcagaccggctttatatcaggcttacatgaatatcattgaagttgaccgcactttgtcgagagaaactaaaatatatgatgtagtcggtccaatttgtgaaacatcggattttctaggaaaacaacgctctcttgcaattgcacaaggagattttatcgtacaacgatcagccggtgcttacggtgcaagtatggcatcaacttataattctcgtccacgagctattgaaataatggttgatggagagcaagttaatttaattaaacgtcgagaggagtttgctgaattgtggcgtttagaaaaattactggaaatgtaaatttttctcgtaaatttcaactaactaaaattgagtttttattctgttgttacactgtgtttttggcaacaaaaattagaatataaaataaaacaatataaaaaactgaataattaaaaataaacaatatttaattccaattaaatataattaattaataaaaaaagatatttaatctaaatttttgttgttgactggataaaatattttgttatattgctaaaccttctgtaatgaaataaaaaatataaaaggtctataaaatgaaagatacaacacaaaagcgagaaacattttccggtcgtcgtgcatttatcttagcagcgattggatctgccgttggtttaggaaatatttggcgttttccttatactacttatgaaaatgggggtggtgcatttatcattccttatttaattgcgttattaactgcaggtattccattacttttcttagattatgctattggacatcgtcatcgtggtggtgcacctttatcttaccgtcgttttaacccgcactttgaaacgtttggttggtggcaagtattggttaattttattattggtatttattatgccgttattttgggttgggctgctagctatacctatttttcaataaataacttttggggagataagcctatagagtttttcctgaatgaattcttaaaaatgggtgatattactcaaggtgttagttttgaatttgtaggaatggtgacaggtccattaattgctgtctggctgattgctttaggaatattagcactaggtgtacaaaaaggaattgcaaaatcatcaagtattttaatgcctattcttgtcataatgtttgtaattctcgttgtttcatcattatttttgcccggtgcggaaaaaggattagatgcgttattttcaccagattggtctaaattatccgatcctagtgtatggattgcggcatacggacaaatatttttctcactctcgatttgtttcggtattatgattacctatgcttcttatctgaaaaaagactccgatttaacaggtagtggattagttgtaggttttgcaaatagtagctttgaattgttagcaggcataggcgtttttgctgcacttggttttatggcagcgacagcaggacaggaagttagtgatgtagcaaaaggaggaattggtctagcattttttgctttcccaacaattattaatcaatcaccttttggtgaatttattggtgtattattcttcggttctttaacttttgcagctttaacttcatttatttctgttattgaagtaattatttccgcagtacaagataaactaagaatacgtcgagtaaaagttacttttattgttggtttaccaatgatgttttgttcagtgattttgtttggtactactacaggtttaccaatgcttgatgtgttagataaatttgtaaactattttggtattgtagctgtagcatttgtttcattagttgctattgtttccaatgaaaaattaacttcattgggtaatcacttaaatgaaacatcttcttttaaagttggttttatttggcgtttatgtattgttttaacaacaggtattctagcttttatgttatttagcgaaggtgcaaaagtattttctgaaggttatgaaggttatcctgcttggtttgtaaatatttttggatggggtatgtcgttaagtttattagttgcagcattcttactttcccgtttgaaatggaaagatgaagcattaacacacaaaaaaggagaataaaaatgagtaacagcgctattatgatgatgatcatctctttggtaattatttggggtggtttagttgtatcaatattaagattacctaaagaatgataaatttcaaataaaaataccgcactttgatctgcactctaaaagatagggttaatttcccatctgattaaagtgcagattttttatgatttcatattaatagtagtaggttataaattccttaaccgtcatctattctcgcatgagtgatgacagtaaaattatgctgaaatagcaattttcaaggtgagttcatgggatgggtatcgatccatcattggtcatcatcaaccaagttaaacgaaaacagtatcacgagtgaggtggagttttttgataacatactctttggttaataactgatttaactttaataattttttgagtctagttttagttttgtgacaatgaaaaaatcccaaaacttgaaataaaaaatgattttatattgatttagtgatgaatcccctgcttttaaacaggggagggtgattttattgtaaaagtataatctcaacaggttttaatcctgccctctctagacctttattaagtttctttaaagcctgttctttttctgttttagtcaatacattgacattcttgtataaaagtgcggcagtaagattccaaaataaaatgagatttacaggaatacctgagagttttaactctatgtagcaatttgctgctccttttaatttaaaggattttatatctttaatgtgtattttagaaagaagcctttcgtgttttatcgaaagatttgggagatcttttattctttttttccgagcaagttcttgtgcaattttctttgctctagtttgagcaatagatagatagagaatttgacgaaaatgttccttattctgtgtaatttcttttggcaatagataataatttcctatatttagttgagggtttggggttaaagctaaatatgataaagcacctaggctttctaggtatttagctaattccttctctgctcgaatataaaattttccttgctggtataaaccaaacataagacctttcttaaataaaccataaccagaaaaaagatttttcacagttatagttcctatcaattcggtaagttcacttctaatattttcagtgtcttttaatgatttggtcatatataattcaacctcatttattgtgacaaaataaataaaaaccttttgattagaaaaaatctccaatcaagataagttataacacagagagtggattttattttaaataactttctaattttgttaaagtttgtgatagagatcgagaatttataaaaaagtttgctattttctttagattttttagagaaatgataaaatatgccaccgatggtttacattattattataattgtttaataactaaacaaaaagattaaaaaaagagaaaattaatcaaattttgataaaaaatataaaaaaagcttgcattgaactataaaatgcctataatgcacggcacacaacgacacgctgttgtgagaggttaagcagtgtgtcgttattttttgttctttaacaaactatcagacaaactgtgtgggcacttgtgaaactgtattaataagagattaaaagagtaagataagtgcttaaactagagaaattcatagagaaaagatggataaaatagtcagtatttattgagcgaagagattaaattgaagagtttgatcatggctcagattgaacgctggcggcaggcttaacacatgcaagtcgaacggtaacggggagggagattactttctctgctgacgagtggcggacgggtgagtaaagcttgggaatctggcgaatggagggggatagccacgggaaactgtgggtaataccgcgtaatgtctaaggaccaaaggggtgggactgtgaggccacctgccatttgatgagcccaagtgggattaggtagttggtgaggtaagggctcaccaagctgacgatctctagctggtctgagaggatggccagccacactggaactgagacacggtccagactcctacgggaggcagcagtggggaatattgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgagctaacccatactaatttcccgaggggcttaaccatacaatcttgagtgttttgcatagaggaagaagcgggacaggatagagagaggaatacttgaagtagaggcttgtttttttattgaagaagagatagagacgggatataagagagaggaatttaacttggcggcgatagtgcggtgggaccacctgacaccatgccgaactcagaagtgaaacgctgtaacgccgatggtagtgtggggattccccatgtgagagtagggcaccgccaagttttttatgttatgaccctaagtggagacacttagggttttttgttatttgggataaggcggggtagagtgaagagggaagaggaaaatgggagaaaaaaagtaataaggtgataacaagggagtcataaacagtagggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcatttatggacagatataattgctaatctacttcagatcattgtaaatttgccttattgtcttattaccttgtaggtaaaagtgcgattaaaaagtcatatgtttctttagccaatgaattactgtatgaatgttttgattgtgtttgtaaggtgttacaatataataacgctgattacacggtttttctaagcctttgaaaggggttattaattggtcattaactaaataaggtgtgattaactgttttctccccattgcgatgccaatatggttaattgcagctgttaatgctaaattcgaacagtcgaataccatggactgtacttggtttaaattaagactgtaattgaaatatgttaaccaactctcccattcttcaaaatcggaattgtaatgccacgcttgtccgtcatgaagcaatagacagtgttctaaagatttcggattcccataaagtttatgtttctcggcatattcagggctgcaaaccggaataacgctttctggcatgagttcatagtgatgtaaattttcactatataaatcatcataatagatagctaaatctactttatacctattgaaatcaataacttcattgccagtcaaaatattcagtgtgataaacggatatttttgattaaatcctgctatagcaggaataagccaactttgagctaaggaagggcgagcataaattgtcaatgtgccactgatttcttgattacgtatttcaaaaatttctttatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttcatcatctcattgagatttttgaagtaggtttgggagatttcttcaggactgaaagcggtcataccaataagctcttgggtacggtgattaccttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaaagctcgcacgctttcatctattaagatagctcgcctatctgannnnnnnnnnnnnnnnnnnnnnnnnnnnnnnnnnnnnnnnnnnnnnnnnnnnnnnnnnttgcccgaaatgtggtgtacaacatcaagcctatttcatctctactcgcaaacaatggcgatgcaaacattgtaaacacacctttagcattacatcaggcacgatttttgcgaatcataaattaccaattcaaacctatttattcgccattgccttattcgtcaatgcagttaagggaatttccgcctgccaactctctcgtgatttgaatgtacagtataaaaccgcttttaccttatcacataaaatccgtgaaagtctgattgtacagcgtgagctttttcccctttcaggtgaagtgcatattgacggcacttacgtgcattccgctccacgtccaaagaataagaaaagtgaacgtgtcgatagacgcttaaaagaaatgccaatccaaacaaacgtgcggtattggttatgcgtgaacgttattcagaacaagatactttaaacaatccaaatcttgttggagcaaagaaaaccatcacttttcctattttgtcagaaaacaccgacaccgtgaagaaattggcaaccgcctatattgagccaaatagctgtattcatgcggatgaaaatagtgcttatgatgaattgatagtagattatgacttacaacgtgtgaatcatcaaaaagaatatcgtagcgataatggcattaccaataatctagcagaaagctattttgctcgttttaaacgcatgtattacggacaagtccataaaatgtcaaatatctatcttgagaactatgcaaacgaaatagcttatcgggaagatactcgtaaactggataatttaacccttttcaatgatgttatcagtaaatgtctcagtacatcatcggataatgactggaaaggttattggcaaggtcatcacaggcaagtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatgataagtcttgaacagcatgttcccaaagatcatcttgtgcgtaaaattgataaagcaattgatgttaaatttattcgtgatgaagtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgttattctccaagctattgacgaatggcctaagcaatctgtcttgatagcagcaactaatcattcagagcttctagatcctgctgtttggcgacggtttgacagtattattgattttgagcttccaaatcaagagctaattaaaaagtatctgatatctaaagatattagtaataatctgtcaaattatatatcaactaaattacatgatgtttcttatgccataatagaaagagccatcaatcaagctaaaaaaaattctatcatagaaaaaagacctttcagtgcaacattaattaatgaattattaggtgataatgttttactggaaaatgttattgaaacgatgttatcaacaaatatttctcaacgaaaaattgcacaagacttaggaatttcaagatctcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattcatacctgctaaagccagtaaaaatatggcattgaaactcgcagaattctcttttctccggaacttaagagaattaccccaattacgggttaatgatcctgtgatattacgttcatctaccaatgactccagtcttagccttccttcagaaggagctataaatcctgatttaaaagtcgcaatattcgatggaggactaggaattaataattttgatccttgggttaaagaatatatatggagtaatggtaataccagtgcgcaattactttctcatgggcaagatgttacatccactgttctttttggtgttgtgaataatgatactaaaaagcttagcgtaccttattgtaatatagatcattatagagtgttagattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatttgttgcgtattatttgcttggtataaaacatcaccaaagtatggaatccttattaaaaaatactgaaaatgggtttatggctattggtaatattttactgattataggtgccggaggggcatttaacagtattttaaaggcgagcggattaagtgatggattggctgagattttagcaaattttaatacacatcctattctattggcatggcttgttgctattgttttacatgccgcagtgggttctgcaacggtagcaatgatgggagcaacggcaatcgtgtcgccattacttgttacttaccctgatattagccccgaaattattgtccttgctattggttctggtgcgataggatgcactattgtaacggattctctcttttggttggtcaagcaatattgcggtgcaaccttgaatgacatttttaaatattataccggtgcaactttcatcgcttccgtattagcactcgggtttacatttttattatcaacagtgatttagaggtatcattatgaaaattcaacatttaatgcaagatcctttcattcaaaaattaatgcgttttgaagaagtgatgtggtttaatcctaaaagtgcgggggtaaaaacaggattgtcttacgttgggttggatgtatccgatactcaacaggcggcggaacgtttgcagcgttttgctccttatttttgtcgtgcttttcctgaaactcaaaaaacgaaaggtattttagaatctgaactggtatctattgataagatgaaatcggcattaatcgatcattatcatatgccaatacaaggacgtttattgctcaaaaaagacagtcatctaccaatttcaggatcaattaaagcaagaggcggaatatatgaagtgttggcttacgcagaaaaattggcattagaacaccatttaattaccgaaaatgatgattatagtcaattgtgcgatgaaaagatcaaagattttttcagccgttatagtattgcagtaggatcaacggggaatttggggctttccatcggtattatgggggctgtactcggcttcaaagttagtgtgcatatgtcagccgatgcaagagaatggaaaaagcaaaagttgcgttcatacggtgtgaatgttgtggaatatacacaagattacggtgtagcggtcgctcaaggacggaaggcagctctttccgatccgaactgcttttttattgatgatgagaattcgacaacactttttttaggttattccgttgtaggtcaacgactaaaacaacaatttttggaacaaggtataaaagtagatgaaaatcatccgctctttgtttatcttccttgtggtgttggcggtggacctggtggtgttgcattcggattgaaattggcatttggtgattatgtacactgcatttttgctgaaccgactcattcaccttgtatgcttctcggtgtttatacagggttacatgataaaattgctgtacaagacttgggtattgataatatcacagctgctgatggtttagcagtagggcgtgcatcaggatttgttggtcgggcaatggaacatttgttagacggtttttatactattgaagatcaaaagttatatgatttactggggctattgcataagacagaaaatattcaacttgagccttctgctttggcaggaatgataggtccgttgcatatcaatcaccccgattatttaagaagatatcacatcacacaagaacaattggcaaatgcaacacatatagtgtgggcgactggtggtggaatggtacctgatgttgagatgcaaaaatatttgtcactcgggcgattttaaaatattctccccaagttggtttttggggagaagaaagagtgcaagtgcggtagatttttagagagtactggaaataaataataaatttgatgcgtcactattttgtttatttttaagtgcattctgatttatttgcaaacatattgcctgttaaacaagcaaacaattaagattttgtaattttttaaaaattattgttgacttaaataagaaaaaaacgtttaatacgcaccactgacttgttgcctcgatagctcagtcggtagagcaggggattgaaaatccccgtgtcggtggttcgattccgcctcgaggcaccattctactcctccttagttcagtcggtagaacggtggactgttaatccatatgtcgctggttcaagtccagcaggaggagccaactctatgttagttatgttatagaaggatgccttattgattattgttttgttaagagggtatcaaatagaaagtcaagaatttatctaaaaaatagattttcccaatttaaatttaattcattttaatagtatcaatcattcatattaaacttaatctcttcaggacatggtagttccgcctttcagtgttccctatgctaatatctgcatcaacaagcacaagttatattgcttgtaatatagaaatagtgcatttgcaatgcttgcagaactaatgttggtgaggtgtgaaaaaatgggtaatgatgaaggtatatttttttcaaagaaaattaaaaaaattaaacgttaaataatgcttaataataaaacaaaagtgcttttcttttgttaatttggtaaagtatatacatcaaaattcaaattaattagttaaaaattaagaaaaatgatatgtatacatcaaatttcactaatttaatcttaaatgtagacagctataaagcatcgcattggttgcaatatcccaaaggaacagaatatatttcctattatattgaagctcgtcgagaaagttttgatgtagtgatgttcggtttacaggcctttatcaaagaatatttgcttaaacctatttgccaacaagatgttgatgaagcagaaattgtattaaaagcacacggattgcctttttatagagatggttggcaacatctaatacataaacatcaaggttatttacccttaaaaattgaagctgtaccagaaggaacggtcttacctgttggtaacgtggtttgtcaaataaccaatacagatcctgattttttttggttagtcggctatttagaaaccgcacttttaagggcaatttggtatccttccactgttgcaagtctttcctatttttgtaaaaagcaaattagacaagctttaataaagtctgcaaatgatttatccggtttagactttcaattacatgattttggtgcacgaggtgcatcaagcctcgaaactgttgcgttggggggattagctcatttagttaatttcaaaggaacagacagtgtttctgctttaattgctgcaaaacgctggtataacattaatgaaatgcctgcattttctattcctgctgccgaacatagcactatcacttcttggggtaaagatcgggaaataaatgcttaccaaaatatgattgaatgctttggtggagagggaaaactttattccgtagtatcggatagttatgatctttggcatgccttggaacatatttggggcgagaaattaaaagatttggtgatcgaaaaaggtggaagattgattattcgacctgacagtggcaatcctatagagattatttgcaaaaccctagaaattttagcaaataaatttggttatattcttaatcaaaaaggctacaaagttttacctgattgtcttcgcattatccaaggagatggcatcaatgctcaaagtctaccaaaaattcttgatgctgttatgcaaaaaggatttagtgccgagaatgttaatttcggcatggggggaggactgctgcaacaagtcaatcgtgataccatgagttgggcaatgaaagctagtgccatttgtattaatggacagtggcaagagatttataaggatcccattaccagccaaagtaagcgttctaaaaaaggtattttggctttagtcaaacagggaagtgattggttaacaattaaacaatctgagttaaatggacaaactaatcagttacaaaccgtttttttcaatggaaaactttttatcgaagaaaacttaacggaaatccgcttgcggaccacgtcctttttagtatgaccatattttacacagtgagaaaaagatgatatttgaaaaagtatcatcttttattttttgcttaacaatgtacttactattttctagctagtggtggtacaaatgtaattcccatatcccaaggctgttcaatccacgtattttgtggaatgtcaataacataatcatcaactaaattagccccagcaggtttggcaaaaacagtaacaaaacgcgcatttgggtagagttcacgaattgctcgagcagtatttcccgtatcaactaaatcatcaactacaataaaaccttcgccaccattttttacctgtgccgcatgcaaaacatttaaattgccttgctgattatggtcataacttgaaatacaaacagtttcaatatgacgaataccaagttcacgagcaataactgcagctggaaataatccaccacgactaacggcaataatacctttccattgtgttgccggaagcaaacgttctgataatttacgtgtatgcatttggaacatgtcccaagttacaacatatttttcgctcataattcaccctaaagtcagttgatagcggagttccgcctgagaaataaaatggcgttagaataacctgaaatctatttttatgctattattttccttatttttcgctaataaaggataaaaaattatgtcagatcttcaatctctgcaacctaaactactttggcaatggtttgatcaaatttgtgctattccacatccttcttacaaagaggaacaattagcacaattcattattaattgggcaaaaacaaaaggcttttttgccgaacgtgatgaagtcggtaatgtattaattcgtaaaccggcaacgacaggaatggaaaatcgtaaacctgtagtactacaggcacacttggatatggttccacaagccaatgaagggacaaatcatgattttgatcaggatcctattttgccatatatcgaaggtgattgggttaaggctaaaggcacaactttaggcgctgataacggtatcggcatggcatccgcacttgctgtcttagaaagtaatgatattgcacatccggagttggaagtattgttaaccatgactgaagaaagggggatggagggggcgattgggctacgtccaaattggcttcgttctgagatcttaattaataccgatactgaagaaaatggagaaatttatataggttgtgccggcggtgaaaatgcagatcttgaattacctattgagtatcaagtcaataatttcgaacattgctatcaagttgtgttaaaagggttacgaggcgggcattctggtgtggatattcataccggacgagctaatgcaatcaaagtgttgcttcgttttttagcagaacttcaacaaaaccaaccgcactttgacttcactttagcaaatatccgtggcggttctattcgcaatgctattccaagagaaagtgttgccactttggtctttaatggtgatattaccgtattacaaagtgcggtacaaaaatttgcagatgtaatcaaagccgaattggcactaactgagccaaacttgatatttacacttgaaaaagttgaaaaacctcaacaagtattttccagtcaatgcacgaaaaatattatccattgtttgaatgttttgccaaatggcgtagtacgtaacagtgatgtcattgaaaatgtggtagaaacatcattaagcattggcgtgttaaaaactgaagataattttgttagaagtactatgttagtgcggtcattaattgaaagtggcaaatcctatgttgcttctttattaaaatctttagcctcgttagcacaaggtaatatcaatttatcaggcgattatccgggttgggaaccacaaagtcatagtgatattttggacttaactaagacaatttatgcacaagttttaggtacagatcctgaaatcaaggtaattcatgcgggacttgagtgtgggttattgaaaaaaatctatccaacgatcgatatggtatctatcggaccgacaattggaaatgcacattctccggatgaaaaagtacatattccggctgtagaaacttattggaaagtattaaccggtatacttgctcatattccatcacgttaaaaattgatatacaagacaagtataaagagcggtgtaaatttgcaaagaattgagcaagcacattagataactttatcattcttaaaactaaaaatccttgtagaaaatcgttttttacaaggatttttgtgtcgaacaacaatctatttaattcaacattttctttaactgatataaacactcaagtgcttgcttcggacttaactcattaggatcaagcgtttttagcgtttcaatcaccgcacttgtattctcctcctcttccattaaagttaattccccttgaacttgtgtcaaaacggattgtgattggtaactgttttgctgagaaagtgtttcaagctgttttaatttctgttttgccgatttaattacattttgtgggacaccggctaaagcagcaacagccaaaccataacttttacttgccgcaccttcctgtaccgagtgcataaaggcaatactgtcgttatgctcaaaagcatcaagatgaacattatggataccgtcgattttttccggtaatcctgtcagctcaaaataatgcgtggcaaataacgttaaactgcggattttttgagccaattgttcagcacaagcccaagcaagagaaagtccatcataggttgaagttcctcgcccaatttcatcaataagcactaaactttgctctgtggcttggtgcaaaatatttgccatttcagtcatttcgaccataaacgttgaacgtccggatgcaagatcgtcagaagcaccaatacgtgtaaaaattcgatcaataggtccgattaccgcactttctgcaggtacaaaactaccaatatatgccattaaagtaatcaatgctgtttgtcgcatataagtacttttaccccccatattcggtcctgtaataatcaacaaatgacgcttttgattaagttctacagggttagcaataaaggggtcttttaacacttgctctacaaccggatgacgaccctgcattatttgcaaaccgatttgcgtactaaattgcggttgaacataatttaaggtttccgcccgttccgctaaattggttaaaacatcaagctctgccaacgttaaactggctagttgtaaatcacctaagtgcggtaataattgatcgaaaatttcatcataaagttgtttttctaacgcaagtgatgctccttttgctttaaggactttttcttcataggtttttaattcaggaataatataacgttctacatttttcaatgtctggcgacgcacgtaatgaagcggtgctttatgtgcttgcccttgactgatttgaatataataaccatgcaccgcattaaaaccgatttttaatgtatcaataccagtatttgcacgctcacgttgctccaaatcctttaagtagcgtgttgctccttcagacaaactccgccattcatcaagctcctcgttgtaaccttcagcaatgacacctccatcacgaataagtaaggggggattatcaataattgctcgctgcaaaagtgctaattgcacagaaaaatcagcaatttgttgtgaaaatgcaacaaagtgcggtatttttgttaattggtgttgaataaaaggtatttgttccaacgctgttcgtagccgagttaaatctcgaggtcgagcggaacgcagggcaacccgagcaagaatacgctccatatcgccaacttgacgtaaaagaggttgtaattcttcaactaaattttgctgcaacagcatttgaatatgttgttgacgacactgcaatttttcaatattgcgaataggctggtgaatccaacgtttgagtaagcgacttcccatcggggtaacacatttatctaaaattgcagcaagtgtattttcagttccgccagcaagattttgggttagttctaaatttctacgtgttgacgcatcaatttgtacagtatcgctattttgtaacaagctaatactttgaatatgaggaagtgcggtacgttgtgtttcttttgcatattgcaacaagcaacccgcagcacataatcctaaaaccgctttttctacaccaaaaccacgcaaatcttttgtaccgaattggcgattaagtaattgaattgccgtacttaattcaaactcccaaagaggacgacgacgtaatcctttgaattgttcaattaaatgtttatcctctaacgcttccgaatatagtaattcaactggttgaatacgttgtaactcagcttgtaaactggcggcatcttgtagttcgctaatttgaaaacaccctgaagtcatatctaaaacagctaagccaaattgtgttttttcttgataaatcgtagcgataagattgtcttgtttttccggtaacaatgcttcatcactcactgttcccggtgtaacaatacgtacgacttggcgttcaaccggacctttagctataacaggctcaccaacttgctcacaaatcgctacactttccccaagttgtaccaattttgctaaatatccttctattgcatgataaggtacgccagccattggaaccggttgtccagctgattgccctcttttagttagggaaatatctaataattcagcagctttttttgcatcatcataaaaaagctcataaaaatcacccatgcgataaaacaacaaaacatccggattttccgcttttatttttaaatattgtttcatcattggcgtgtgattttcgaatgtgtgcatggctttcattgtgttaataagtaaaaagaataagtggaattataacaaaagtgcggtctgttttgctggtgttttttgtatctgctttcaagtcaaaagaataaaaatatgtctaaatgatcaagcggttgctcctgccttttatatttttatctcgtttccactaaataaagggtcaatttccggcattacgccacgccataaataaaatgcgtgagcagcttgcccaaccagcataccgaagccatcgctaattttggttaccccttgttttttacacaatgcaataaaaggcgtgtcgctttctttgctgtattgcatatcataaacggcagaggcaagttgtaaaatctgaggatcaatatcaatagttttaccttgtaatcctgttgatgtagcattgatgattaaatcaaatgtttgtatcggaatatgttccagatccaacgcttcaatggtgccaaaatgattgaatttatgtgctaagtcttcagctctactaaaagtgcggttggtaattaagatattttgttgagcttgtaataaaggcaataaaactccttttgtggcaccgcctgcgcctaaaatcagtattctttggtttggtttgagccaatttaaacgttgtaaatcgctcactaaaccggcaccatccgtattatcagcaaataatgttccatcagctaatttttttaaggtgttacaagactccgcacttaaacaacgcttgctatgttgttgtgccaatttaaatgctcgctctttgaaaggagcggtaatattgcagcctttagcaccttgtgcaaaaaaatcgctcaactgttgttcaaatttttcttcatcacccaatatcgctacataatctaagttttgtcgagtctgcttcgcaaaatatcgatgaagttgaggagatctactttgagcaatgggatttccccaaactgcgtatttatccattttttatccttgtctaactaattgattagtaaataaatcacgaatttcagatggttttgtggctgagccaactgacatatccaatacaggaaaatccgccccgaattgtaacctgacttcatcgctggttttgcaaggtgcaatcccacttaaattggcactggtagaagttaaagcaaaacctgtttgttcgcaaagtattttgatggcgggatgttggcttactcgaatagctatactattaaaattgccacataagaatttagcaatatctttttttgccggcacaatccatgtaatggggcgaggataagtttgttgtagtttttgccaatgttgagaattgatctgttccttatcaataaaagaaaaaaaataatctaatttgggtgcaactaaaattaaacctttttctcttgggcgttgctttaaaattaataatttttctaccgcactttgactaaaagggttgcaacctaaaccgaaaacagcctctgtcggataggcgacgacttcattttgtttcaatttttcaataatttgtgtgatattcatattgttgttttgaaaatatgttgacaatttttattgatacacaaccaagtgcggtgattttcgtctttttttttcaagattgcaccttgcatttggcaatgggggcaagggattaaatgaggtttttgtgctaaggtaaatttgcatttcgggtactgattacaagcataaaaattttttccttgccgtccatgtcgagcaacaatttcaccatgttgacattccggacaaacaatctgttgttctgtcgtttcttgttcttcatgcacgacaaaacgacattccggataaccgctacaaccgataaacatgccgtaactaccctgttttagttgtaaaaaacgaccgcacttcggacaattttgagcaagatttttaagtattttactttcattattagggtgtaaaggcttgatataatcgcaagatggatagttagaacaacccaaaaacaaccctttttttccttgtttcatctgcaaaacagcttcacattgaggacaatgttcttgatgtttggtatgttggaaaaggctttttgacatattcttttttcaatccttgtgagaaaaaacaacaataaacgatcctatcaataatatcaacttacaatcctaatttgaaagccattctagcacagtgtagaatgtgcaacattgtatttaggataagagttttatgaatttacaagatcattttttgattgccatgcctcatttagaggacgagaattttcagcgttccgttgtgtatatttgtgaaaataatgaacaaggctcaatgggattagtgctaactcaagcaacagatttaagcattgctgaattatgtgcaaaaatgaattttatgatggcggatgagcgtgaatattccgataaattagttttattaggtgggcctgtaaatttagagcatggttttattttacataagaaaacagcccaagaatttcagcatagctataaagttacagatcaaatttatcttacaacttcggcggatataattaatacttttggtaccgcacaatcaccggaaaaatatttggttactctggggtgtgcaagatgggagccgaatcaactggaaaatgaaatagccaataatgattggttggttgtgcctgccaatgaaaatattttatttgatgtgaacagttcggaacgttggtttgccgctaatcaattattaggtattgagcatgtaaatttttcgtatcaacaacaaatggaacatagttaatgtcaattacagttttagcctttgattttggcacaaaaagtatcggttgtgctgtagggcaaagtataacaggtacggcacaagcactcccagcatttaaagcacaagacggtatacctgactggttaaaaattgaaaaatgtttgaaagactggcaacctaatattgttgttgtcgggttacctttaaatatggatggtagcgagcaagatctcactcatctagcgagaaaatttgctaatcgtttgaacggtcgatttggtgtgaaagttgaattacaagatgaacgcctaaccaccaaacaagctcgtgatgaaatattccaacgaggcggttaccgagctttaaagaaagaaaaagttgatagtatttccgcctgtttgatcctagaaagttggtttgaaaacggagcttatgaaaagtaatcacactaaaattaggtcaatttccatttcttttatcgattcttgagcatttagtaacagtttgtcatcgcaaataatgctattgaatacgcttaattcacaaatagaaaatgtagctgtttttccatatttagaagaatcagataccaaaattttgttgtaactggattgcaatattgcttttttaacaggcagttttttctcatccggtgtagttaagcctcttaaattccaagatgatgtggaaataaatgccagatcaattgaaagctgtttcaataactgtgtagccaattcaccaacagaggagaaattagatttattaattgatcctcctgtatgaattaattcacattgtccatgtttcatcaagaaattagctatcacaaaatcatttgtaatcaccaacagatcttctcgttgagcaatattatgtgcgatttctaatgttgttgttccggcatctaagtagatagttgtatttactggtattagctcagccgctcgactaccaattttttctttttgtagcgtggaaagcaaagatttgtcattgtgtgtcggttcaataaataaatgttctaataatttcacaccgccggaaactgaaacaacaataccttcttgctctaatttttgaatatctcgacgaacagtcatatgagatacacctaataattttactaattcattgatactaataatctcttgcttactaatcagcttaagaagttttttttgtctttctgccggtatcattttttactcctgattttttacataattatatcactttttccatttaggctaatatctataaaattaacattatttaacaaataatgttaaataatgtgatcgtgatctcattttttttgtaaaaaaaagtgcaaaatacaccatcaaataactttaaaggagtgatcagtatgaaccaaaaactattttctgtcgctgttattggtttaggtgcaatggggatgggagctgcaaaatcatgcattcaagcaggattagatacctatggcgttgatttaaatttacaagccttagagattttaaaaacagctggagcaaaacaagtgagtacaagtgcgataggttttgcaaaagatttagatgcagttttgctattagtcgtcaatgcaaatcaagtaaataatattttatttggggaacaaggattggcacagcatttaaaacctaaaactgcggtaatgatttcatccactatttctgcacaagatgccaaagaaatttcacaaaaattaacaaaacttgatttgataatgttagatgcacctgtatcaggtggagctgcaaaagccgctcaaggtgaaatgacggtaatggcatccggatctacagaagcttttgagaaattaaaaccggttttagacgcagtttcaggcaaagtgtataacatcggagaagagattggtttgggtgcaaccgtaaaaattattcatcaattactggcgggagtgcatattgctgcaggggcggaagcgatggcattagccgcaaaagcaggtattccacttgatttgatgtacgatgtagtaactaatgcagcgggcaattcatggatgtttgaaaaccgaatgaaacatgtggtagatggcgactatacgcctctctccatggtcgatatttttgtaaaagatctcggtttagtgaatgacacggcaaaatctttacattttccacttcatttagctagcacggcttattcaatgtttactgaggctagtaatgcaggctacggtaaagaagacgatagtgcggtaatcaaaattttcagtggtcttgatctaccgaaaaaaggaggacactaagatgttaggtgtcatagcagatgattttactggtgcaagcgatattgcgagttttttagtcgaaaatggcttaaaaacagtgcagatgaacggtataccaaaaaccgcacttaacagcaaagttgatgcaattgtaattagcttgaaatcacgttccaatcctgttgaggaagctatccaacaatcgttacaagccttagattggctaaaacaaaatggctgtacccaattctatttcaaatattgctcaactttcgatagtactgaaaaaggcaatatcggaccggtaacggatgcgttaatggctgcattagaaactgattttactgtcattactcccgcacttcctgttaatgggagaactatctttaatggttatttgtttgtaggtgatgtattgctgaatgaatccggtatgcgtaatcatccgattacaccgatgaaagaggctaatttagttcgcttaatggacgcacagtctcaaggtaaaactgggttattgacttatgcagatgttattcaaggtgcagagcgtgtgaaagtacgttttacagaattaaaacaacagggctataaatatgcagtagtggatgcggtagataattcacagcttgtggtacttgctgaagccgtggcggattttaaattggttaccggcggctcaggtttgggggcttatatagcagcgtatcgctcaggcggtcagaaaggaacgaatgcctttgtaccgaataaaggcaaaacggttgtgctttcaggatcctgttctgtgatgacaaacagccaagtcaatgcgtataaagcccaagcaccaagttatttcttgcaagccgagcaagccattaacaatccaaattatgtggaagaactttatgcgtgggttgttgaaaatctaaacggcaactttgctccgatggtttatgccactgtaccgcctgaaaaattgaaagaaatccaacaccagtttggtgggaataaagcaagccatgcgattgaaactacatttgcaaaacttgcaaaaaaattgaaagttgcaggggtaactaacttcatcactgcaggcggtgaaacatcgagcattgtagtccaggagcttgctttctctggttttcacatcggcaagcaaattgcacccggtgtgccatggctacaagcagtcgaagagccaatttttcttgccttaaaatctggtaacttcggtaaagagaatttctttagttttgcacaaggaatgtgtgtatgacagaacttgaacaaaaacaacaaatggttgctttagctcgttcattatttgagcggggatatacagtaggtggtgcaggcaatctatccgtgcgtttagataaaaaccgtattttagtcacgccaacaggttcttcactcggacgtttagaagcagatcgactttctgtgttagatatgcaaggaaatgtgctttctggtgataaaccgtccaaagaatcggttttccacttagcgatgtatcagaaaaatccgagttgccaagcgattgtacatctacattctacttatttaaccgcactttcttgtttggaagatttagatacggaaaatgcaatacgagccttcaccccttactacgtgatgcgtatcggcaaattacctgtaattccttactatcgcccgggcaacttcaatattgccaaagaattaggcgagagagctttagacggcaaggcttttctgcttgcgaatcacggagtggtagttacaggagaaagcctaatagatgccgtagataatactgaagaattggaagaaaccgccaaactctattttattttacaaggtcaaaaagtgcggtatttaaccgatgatgaagtcaatgacctgaaacacagaggaaaataaacatgcccaaatttgctgcaaatttaaccatgatgtttaacgaagtcccttttttagaccgttttgaagcagctgctactgccggttttaaatatgtggaatacctttggccctatgattatccagcagatatgctaaaggaaaaattagataagtatggtttacaacaagttctatttaatacttcagcaggcaatgtagacgccggcgaatggggtgtctctgcgattccgggtcgtgaagcggatagtcaccgtgacatcgatcttgctcttgaatatgctcttgccttaggttgtccacacgttcatgtgatggcggcagttgtaccgcaaggcgaagatcgagaagcctataaacagactttcatcaaaaatgtgcaatatgcggcagataaatttaaaccgcacggtattaaagtcttattagaagcactcagcccggaagtcaaacctaactacctgctgaaaagtcaattcgacacgctagaaattgttgaatccgtcaaccgagataacgtctttgtacagttggattatttccacgcacaaaacgtagatggcaacttgtctcgcttaaccgacaaactcaacggcaaatttgcccatatccaaattgcttccgtgccgaatcgccatgagcctgatgaaggtgaaataaattaccaatatctctttgataaattggatcaaattggctatcaaggttttattggctgtgaatataaaccacgctctgacaccttagcaggtttagattggtttaaaccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagccctatttttcatgggtagggctttttgcaccctgcaaacccaaaattgcattaaaaacaagcggtttttgtttaaagtgcaatctattttaaggagaacacaatgaaaattgttattacaggaggacaaggttttttaggacagcgtcttgcaaagactttgttatccaattcaactttatcaatcaatgaattagtgttgattgatgtcattaaacccattgcaccaaacaatgatccacgtgtgcgttgtttggaaatggatttgagaaatcctgaaggtttagatgaaattattaccgaaaaaacaaccgctctttttcacttggctgcaattgtgagtagtcatgcagagcaagatccagacttaggctatgaaatcaatttcttagcaactcgcaatttattagaagtttgtcgaaaaaataatcctaaagtgcggtttattttttcaagttctttagcggtgtatggtggtaatttacctgaaattattcaagatcacaccgcagttacaccacaatctacttatggttctcaaaaagcaatgtgtgagttattgatcaatgattattcacgcaaaggctttgttgacggcattgtagttcgattaccaaccatttgtattcgtccaggaaaaccaaacaaagcagcctcttcttttgtaagtagcattattcgtgagcctttacagggtgaagaagccatttgtccggtttcgtcagatttacgcctatggctttccagtccaaataccgtaattaataattttattcatgcgttaactttgccatcgctaccacagcgtagttggcacattattaacttaccgggctttacggttagcgtaaaacaaatgttatctgatttagcttcaataaaaggtgaaaacatcttagaaaaagtgcgatttgaatttgatgaaaatatcaataacatcgtcgcaagttggccggcagagattgataataaaactgctcttaaacatggctttaacgtggatgctgatttcaaagaagttattcaacaatttattaaaaacgatatgtaacttaggagcaacagtatgtttgacttaccaattccaatcattggactattgattgcggtatttgtcttagtctatttagtgttaaaaacacgtgttcatgcatttattgctatgctgattgcttctgcgattgccggccttgttggcgggatgtccgttaatgaaactctcggtgccattagtaaggggtttggtggaaccttaggcggtattgttattgttatcggtttaggggttatgatgggaagcgtgcttgaagtttcaggggcggcagaaaaaatggcttacagtttcatcaaactgctcggcaagaaaaaagaagagtgggctttggcaattaccggttatattgtaagcattcccattttcgttgattcagctttcgttattctttatccagtggctaaagcattggcaaaaaacggaaaacgttctcttttaaccttaggcgttgcacttgccggtggcttagtggtaactcaccatactgttccaccaacacccggtcctttaggtgtggcaggcttatttgctgttgatattggtgctatgttgttagtggggatggctctcgctatattgccggttattggcattgttctttacgcaaaatggctagataaaaaatatccggaatttaaccaacaagttttcactcaagaagaattgaaacaaaaatacgatgactatattgaaagtcgtgagaaaaagaacttaccaagcttagggttatccttactgccaattgttttgccaatcgttctgatctttatcaaagcaatgtttgatttagctgcaaaaggtcatgcggaactggctcaaatgggagtttatcaattctttgcttttgttggtcacccaatgattgcattagcaatcagcgtattagttgctgtttataccttattaccaaaagcagaccgtgattcgaccgcacttcatctcgaagaaggagtcaaaactgcgggaattattttattggtaaccggagccggtggtgcattaggtgctgtgctacgtgacagcggtgcaggtaaacaactagcggaacaaattgcttcattgccaatttcaccaattcttattccgtttattgtttcaacccttgttcgctttattcaaggttccggtacagttgcaatggtaacggcagcctcaatatccgcccctattttggctcaaattccaggtgtgaatatgttgttagcagcacaagcagccacaatgggttcattattcttcggttactttaacgatagcttattctgggttgtgaaccgtatgatgggcatcaatgatgtgaagaaacaaatgatagtttggtctgtgccaaccacgattgcgtgggggattgggggtatcagtgtgattctctgtaaccttgtctggggtaacgatggctcattatttgatcttttgttccctattgctgtaatggcaattattgcattctacatcaagttccaaaatagaactttgaataaataatcaacgcgcaaatagactatgaatgttattcgtagtctattttttaatctaaatgaggagtgaatatgaaaaaatattttattttggctagtggtttgctgttgtccactttggcctgtgcaatacctgatgaaattaaacctaattccaatgtgaatataactttgctcgcagaagtaaccgcacaaggatggagtaaggattgcctatcatcatttctattactctattaaattcttcatagaatctatgatttagagtgataatctgctgagcgtaaaggcttagtgtttcttgtgcactgtctaaatgattcattttcttccctcacaagagattaaagctcatcaaaattttgaaatttacgcaatgataataaccccatatttgagcaccaaataaaaaatcactcaaatataattgacaaccattattattttattttaatgtgaatatgctgtagatcgttatagcaaaattatcaattaacaaaaaactataggaggcaactatgcgtggacgtcgactaaactaattctataaaaaattatagaggtaatctaattagatcgcttctatttatcctctatataaataaggaagcatctatgaaatatatcacttctaaacatgtattttttgactatctaaatgaaaatgaatttgttattgggataggtagtaaccaagaaattacaaacaacaaagattattttaataattgtctaaatttatgttatttttgtataaatcctaagagcatttctgaaatattatcttttataaaagataataatatagacattctatatttcgataaaatgaagaaaatgaagtttattacaaaagaaataatagacttcaatgatagatacagtagaaatcatttatactataatgcattaggatataaaatatatgatatacaaaataaaatatctaaatctcatattcttattgttggtgcaggaggcataggaaatatttgctcctatttattaggaacaataggaattaagaagttaagtatcattgatgatgatatagttgaggaatctaatctaaacagacagttcttatttcgagagaaagacataaacaaaaataaagtagaaacaataaaaagagagttattatctattcggaaagatattattattgatattttcccagagaaattaaataaatctattttagataaaatatcacaaatagatttagttatttgttcagcagatgatgagtattgtatagatatgattaatgaattttgctgttttaataaaattcctctaattaacgtaggttacctcaatgatatttctgttatcggaccattctacattccaaagttagaatatagctgttgtttatgttgtgataagtctatatatttagaaaatgatgttatagatgaaaaagtgaagaaaattaaatcagttacgaaagcaccatctactatcattaataatttctttgctggtgctatgcttggttcagaacttattaaattctttgcacgcgattacaaatcaatgcaaagtattaattctgtaataggaattcacaataagaattttaagtatgaagaaattaagttagccaaaaattataattgcaaatattgtggagtaaataatgagacactatgaaaaaatcatcactagctgtgtatctacctctgcaacccgtatgctgattggggcggtctccacagtttatatgcttgtatcaggcattaatttatatgaagttgggttaattaaaagcactcaggctattttgatttttgtgctgggatttgcagtcggcattctgtcagaccgaatagaacgaaaatggctacatattaccgccttaattttttcgactttttggctctattttttctaccttgcgggtttatacaagagctttaacctctttttattagcagaaatcctcaatgcgatttctctctgtatttatcaaaacaataccaatgcttatttagtagatcagttttatcacgagcaaccgaaaggtgaactcagtcttgccttaggaaaattaggaaaatgggagttttccttgatggcattttctgctttattaggagggggcttatactctacgctatcagagaacctctttttattaacaacgattattatgtcgatcgttacagtcgcttcctttattttgcttcccaaggtgagcaggagagctacacataagactctaccatttattcaaaagcaggactttttaattcttatacgtaaattcagtcgctacaaacaagctattttcttatttgtggtgctaagcctctattttcaaattatcattcaatattggcaagcagttgtttacgccataaacaaatcagagcagaatggacttattctaggagggatgctatttttgatgtttatggtacaatcttgggcaggaaaagcaattgaggtaaaatatccattcagtcgcttaacccttgccttaagctttctcagtagtatggtgttatccttttttgcagaacggtggcaatcggtcttcttttacacaatcgccatttgcttagcattatttgtggtacgatatacagtgattcaaaccgacacagagctacatagacatttactctctcgctttagagcaaaatacgatatgctactcaactcattagtgagaattttaaccgctgtagtcttactgatcattggttatataagcaatctttatggtatacaagccattcaaatcattggattaataattgctatcatatttaccctttttgcattaataacttcacaaaatgtaaaatagaaaaaacttaacccattgtttaagatgagaaaatggatgtttttatagtctattttttaatctaaatgaggagtgaatatgaaaaaatattctagcaccagtattgcattattacaacaataagtatattcaagtgaaagtgtgtcctatgaaatacagaacgcagttcttgaattaaattaggttaacttaaaaacggtataaacctatgtaatcagttatcatattaaagatattagctcgttgggtttattccaaaccaatgagctttttcacagtaaatttctttatgttgttttagattcctactataacggggtttacattgaatagatatccatcaaaattagtgtcctctacatcggataattcaagcaatttagttttaacattttctagatgttgccacattgctttacgtgccaaagcaggatttttgcgctgaatcgcatttaaaatcgtttcatgatctttaatccataagtgatggagatcattatgtatgatacgcgaatgaagctgtgtccacatagcattattaaaacgatatttccaaagttgctcttgagtttgaataaggacatcgtttccagtaatttcggcaagagcaagatggaattctttgtcagcactgcagtcatcaatattttgagcaaataattccttttctttatcaagaatttgcctaagtcgtaaaatatcttgtttggtaacctgttgtgcagcaaattcagcaatactgctttctaacaattgtcgtgcttgaagtagttcaaatggacctacatcttttagcttattatccgcttcttcttgaagaagatctgggatttttatgacgtatattccggatccttttcttacttcaataatcttttccacttccaacattactatcgcttcccttacgatagttctacttacttcaaatctttcagaaatatttctctcggtaggtagcttatcgcctattttgtattttccttgagaaatttcctctttaagtatttttcctatttttgtgtaagttctagaattattttgcataaatcctcgcaatattggcacgccaaaataaatttatgtgatcagtatcacaattatagaaaattggaataccaaaaaatatactttgatgttactgtctgttcataaaatatcattgacgacattaaatgtcgattaactttgttaaagagggaaacattatgagcaaatacgtaagatcagtttgtctcgtggaacctaagaaggttgatataaagaccgtgttgtatcctaaaaaaggtgagtgtgatgttctgatcaaagtagagagtataggaatctgcggatctgatattggtgcatttagaggtactaatccgctggtaacttaccctagaattttaggacatgaaattgttggtacagtcattgaagctggtgttggtatgccaaaaaatattaatataggtgatcgtgtcattctcgaaccttacatttattgtggacattgctatccttgttcaatcagtagaacaaattgctgtgaggcactaaaagttttgggggtacatattgatggagcaatgcaagaaattgttagacatccagctcatatgcttattaaagcacctgatataccgatacatgaactggctttagcagaacctttaactatttcattacatgcaattcgtagaaccaaagtaaaagccggtgaacacgttgctatcatcggtgctggtgcgattggactgatggccgcattagttgccaaagcttatggtgcgacaccaattttaattgacattttagacaagcgattagattacgcaaaatctattggcattccaaatataattaacccagcaaaagaaaatgatcttgaagctattaaatccattactaacggaagaatggctgaggttgttattgaagcgtcaggagcaaatattgctgtacaaaatacgcttaaatatacttcttttgcaggacgtattgctttaactggatggccgaaaaacgaaacgccactaccaactaatttaattaccttcaaagaacttaacatttatggagcaagaacaagcaagggggaatttgaagaagcattaaaacttttagaatccagaaagattgaaccgaagaatattattagtaaggtaattacatttgatgaaattcctcactacatcgaagagctttcagaaaatcctgatgattatttaaaaatcattgctgtattttaagtcttaactaacctatgaggtaataattatgaaactcaaaaaattaactaaagtattagttgttgcaggcttagtatttagtagttcggcatttgctaaaactgtaattaaaatcggacattttaattccgatatgcacccgtcaaatattgtattaaacgaagttttcaagaaaaccgttgaagaaaaaacgcaaggtcgctatgaaattcgtattttcccaaataatcaattgggcggcgaagatcaaatcgtaaatggcttacgcaatggtacgattgaaggtggaattaccggcttattattacaaaatgtggatcctatttttggtgtgtgggaaatgccgtatttatttaaagacaatgttgaagcgaaaaaggtattggaatctccgattgcaaaagaaattggcgataaaatggaacaatacggtattaaattattagcttacggcatgaacggttttcgtgtgatttcgtccaataaaaaattggaaaaattcgatgatttcaaaggattacgtttaagagtgccattgaattccttgtttgtggattgggcaaaagcaatgaatattaacccgcaaagcatgcctttaagtgaagtctttactgcattagagcaaaaagtgattgatggtcaagaaaatccatatatgttgctcaaagattccggtttgtatgaagtacaaaaatacattatccaaactaaccatattttctcaccgggattattgcaattaagcttgaaaacttggaataaaatgtcaaaagaagatcaagaaattttcttagaagcggctaaattatatcaagagaaagaatgggaattagcgatgaagatggaacaagatgttaaagacttcttccataaaaacggtaaagaagtaattattccgtccgagcagtttaaagcagatatgttgaaagcctctgaaacactttatcaaaatttttatcaaaaatatgattgggcaaaaggcgtgattgaaaaaattcaagccgctaaataattgaaatcataggctgtttgttagcaaacagcctttttcctatcgctttttaggagataaaacaatgaaattttctaccgcacttgaccgcactttaaagatgttggcagtgattgcattagtgacaatgattttattggtcttttttaatgccatgctacgttattttttcgattcaggtattgcttggtcggaagaatttgctcgaatttgtttcgtctatatgatttttttaggcattatcttagttgccaaagaaagagggcatttgactgttgatattgtgatttcttatttacctgcatacgtacagatgtatgccttattttttgctgatatattagtgttgcttgccttatcttttattacttatggtgcatatcaattaatgttgctgacttatacacaaaaaatgcccgcaacggaaatttctaccgcatttttatatttagcagctgtgatttcttccttatcttattttctcgtggtttttaccaatttatggaaacatttaaaactggcatttagaggagggaaagcatgatgttaggattatttttaggtagtttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgctgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggtgcaattttaattccaatgatggtagctaaaaaatatgatgttgctcgttctacaggtttagtttgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggctgcggcaatgatttctgcatttgcaattactgttgctcaaattccaacggagttggtgcaatttatcaaaggattaactgacaattcaacggtattaatgttggttattatgattttcttattactcgttggttgtgtaatggatttaattcctgcagtattaatttttgtacccgtattattgccagtattgagagcttacaatatcgatattgcttattttggcattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtgccaatgaattggttatcttagtggtgcttattatatccattgttataaagacaaagttgtcgtaatgacagaagctggcaacatgaataaagcgatattttgtaataaaaataacgtatagatcgcaatttttacaaattgatttgacagaaaagatattcgggtgtaaaacattttttacatttcattaacattttggaacgttttatgctcaccattcatcatacgagtgaacaatcacttctctgtgaaattgctcctcctgctgaacttgccaagcaacagcgaatttggcaaattgcagagcaggctaggcaacttgccaatgtgcaagaagtagtggttggtatgaataattttactgtctattacgatttatttgcagatagtcaaccattaattgaaagcctgcaatcactgtgggaaaattatcaaccacaatcagttaaaacaccacgctgtattgagattccagtgcattatggtggcgagtttggtgaagatttatttgatgtagcacaatttcaccaaactacgccaaaagaaattattcgccgtcataccgaacctgtttacactgtgtttatgatcggttttcaagctggatttccttatctaaacgggttacctgaaaatctttatacaccaagacgtgatatacctcgtactaaggtgcctgcaggctccgtcggcattggcggtagtcaaacaggaatttatccttttacctcaccgggtggctggcagttgctcgggcgtactgatttagcactatttgatattcaacaatctccaccaacactattaagtgcgggtgataatgtccgttttgttgcagagagtattcaactatgatctacattaaacaagtgcaaggttttgctcatattcaagatttaggtcgttatggctttcgttctctcggtattggacacagcggtgcaatggattctttggctttacaagcaggcaatttgttactaaaaaatgcaaataacgccccagcaatagaaattacgcttggtggaatgagtttgacatttgattgtgatactccattttgctttactggtgcattagtagaggctgaactggatggcatgcctgtattttcctactttcgttatactgccaaagtacgtcaaactttaacgcttaaacgtattataaaaggtaattatacttatctttgcgttgccggcggttttcttgtaccacaggtgcaaggctcagccagtactgatcttagagcgcaatttggggggtatcaggggcgtatgttaagagcgggggactgtattcccaccgttttgcgtgatatacagttatcatttctcagcattgaaccaattgattttactcataagattgggacgacactttcgtctgaatatgaggcatttactactgaaagtcgtgagcgtttcttccaacagagatgggttctacaaaataacagcagtagaatgggctaccgttttgcagaaaattcgttaaaactgaccgcacctcttgaaatgctttcctatgcggcacctgctggcacagtgcaagtgccacctgatgggcaacctattgtactaatggcagatgcacaaactacaggaggttaccctaaaattgcttgcgtgattagtgctgatcttggaagacttgctcagacatcgattggcagtgcggtgcagtttgaattattaagccgaaaacaggcggtggcacgttttaaacaagatcagaactatttagaggatattcggagaaaggtaaatgaaacagattgatttaaatgtagatcttgctgagggctgtgccaacgaccagcaacttttacagcttgtcagttcagcaaatgtttgctgtggattacatgcgggtgattacaacgaaatacgcaaagcgattttgtgggcaaaagaaaacgatgtacgaattggagcacaccctagttttcctgatcgtgaaaattttggtagaaccaatatgcaattgccagatgatgagcttaaggcttgtttattttatcaacttggggcagtcaaagcattatgtgatgcgtccggtgtgacgatggaatatgtaaagcctcacggagcattatacaatatggcagcgaaagatcctcatttagctgcacttattgcagaaacagtgaaaagtgttgatccttcgcttaagttaatggggctttctggcagtatcatgctgactgttgctgaacagcacggtctagcgactatctctgaggtctttgctgatcgacattaccttgctgatggttcacttgtgcctcgtactcgtgatgatgcaatggttgagaacgatgaggaggctatttctcaagtgttacaaatggtgcttgaaggtactgttccaactgttgatggcggtaatgtggcaatcaaagccgacagcatctgtttacatggtgatggtgaacatgcagtcgtatttgcaacgcgtattcgcagagagttaaaggagaaagggattttggttacaagttcaatttagtaagaattttactaaaaataggaatagatgttatttgttctagtcgcctttcttttggttgtttttcttttacaaagcaaagaaaaatagccttgatttctaaaacaaaacataaggaaaacacaatgtcaaacaataaccgcagtgcccttattggagcggcatttttaatggcgacttcagccattggaccgggtttcttaacccaaacagcgacatttacccaaaacttatttgccagttttgggtttgtgattttgctctctattttgcttgatatcggggctcaattaaatatttggcgaattattgccgtttccgaaaagaaagcccaagatgttgctaatgcagtattgccgggtgcggggtattttctcgcattgcttattgtgatgggtggtttagcgtttaatattggtaatgtgggtggtgcaggcttaggtttgaatattcttactggagtatctcctgaaaagggagcaattatcagcggtattattgctgttggtgtattcctatttcgtgaagctggtaaagtaatggatagatttgctcaaattatggggtttgtgatgatcgccttgactgtctttgtggcagtaaaagccaacccacctatcgctgatgccgttgttcacactttcttacctgaaaaattagatgttattgcgattgtcacccttgtgggaggtacagttggtggctacattacttttgccggagctcaccgtttattagatgcgggcattaaaggaaaagaaaacttaaaagaagtgagcagaagttctgtttctgcaatcttaattgcttccattatgcgtgtggtgctgttccttgcggtattgggtgttgtttcaatgggtgtccaactggatccaaaaaacccagcctcaacaccatttgcttacgttgccggtaatgtcgggttaatgattttcggtatcgtaatttgggctgcatctattacctctgtgattggtgcggcgtatacctctgtatctttcattacctcattttcaccattcatcgaaaaacacaaaaattgctttatcgtggcatttatcgtgatttctaccgttgtgcttgctaccataggcagaccagcccaagtgctagtgttcgtaggaacattaaatggtttaattttacccatctcactcggtttagtcttattagcagcttataaaacaaatattgttggtaactataaacaccctatttggatgacaattgcagggactattgttgtcgtaagcatggcaattttaagtattataactctctcaaaatatgttttggggctgtttacttaattgatttaaggcgatgatagcaattttcggtttctctttacttggaagagaaacctttttccattatgatcttgtctaaatttaacgttgctgtgtaaacatatattgcaaatgtataaaaatctatccttacttttacttgatgatttgttcgatttagaattagttgcgggtcttactcaatgtgagaaaggtaattaccttgattctatggtagatagacaacaaggaatgagtggctatatgttacaattaactacttttggcacaggcattatttttgatggtaaacattctttttccactcatcgaggacaattgttactattcacaccaagtgcggttcaacattatcacagacatccagaaagtcagtattggcactataaatggatctattttttaccaaacccaaaatggaataaatggttaaattggtcaaatatggaggaaaaaatagggcgtattaccattagtgatgaccgctactttcaggaaatcagtcagcttttcagcaaaattgaagtcgaattgaaatcaagtaaattttttaaagaagatgtagccaccagtctattagaatacttacttatgaaaagtatttctgccgagaaaattgaagttattccagtaattgatcagcgtattttaaatgtttgtgatttaattttgaccaatttggctaaaaatgacagcttagaagcactagcaaaaaaagtatttttatcgccatcaagattatctcacctttttaaacaatctttgggtattggcttagtgcaatggagagaagtacagcgtatttccgaagctaaaaaattactttatttctctaacatttctatctcaaatattgctaaatctttaggctatgaagattctctctacttttcgaaaattttcaaaaaacacaccgcactgtctccgtctaaatttagaactttagaaagatgtaaaaacaatgaaatgtgatccagatctcactttactttgtatagcagaattttccatattgataaaaaaaagttacctatttttccctcacacaaaagcataagataaaaatggctttaatagtatggtttctattagagaggtaatatcaagctttttatacgatattcaattaaaggacttcttattttatgagggaagaataatgaaaaaactcactttaaaacatacattattttcaggtattttagcactgacttgttatggttcagttcttgctaatgacgtagttaatatttctaaaattgacggtatgccatggtttaatcgtatggcagaaggtgttgtacaagcaggtaaagataacaatattaatgcttatcaagttggaccatcaaatacagatgctccacagcaagtgaaattaattgaggatttaattgcaaagaaagtcagtgctatttcaattgtacctaatgatgcaaatgccttagaaccagtgctgaaaaaagccaagcaaaatggtattgttgttttgacgaatgaatctgtaggtcagccaagtgcagattgggatattgaaattattgataatgcccagtttgctgccgattatgttgaagaagtcgctaaagcaatgggcggtaaaggcggatatgttatttatgtcggtggtttaaccgtacctcaacataatttatgggcagatctatttgtaaaataccagaaagaacattatccagatatgtttgaagtaaccagtagaatgcctgttgcagaaaatatcaatgatgctcgccgtaccacaattgatttagtcaaagctcactctgacttaaaagcagtagtctctttcggttcacaaggtcctatcggtgccggtttagccgttaaagaaaaacgcttgaaaaataaattaaatgttttcgggatgatgattccttctcaagctgcaaatttaattaagagtggtgatattacgatgggtattacctacgatccagcaagtgcgggttatgctcttgctgcagttgctgccaaagtgttgaaaggtgaaaaaatcgaagatggtttagaactccctaatgtcggtaaagccaaagtggatacagagaaaaaactcctccaattccataatgtacttaaagtaaccaaagataatatcgacaacttatattaatctatattgaatatgggttctttctgaacccatatttctctcaggaggctttatggcatttattttgatgcaaaatatcaataagacattccacggtgtaaaagccttaaatcaagttaatctctctttagattatggagaagctctctgccttgccggacaaaatggttgtggaaaatccacgctaatcaaaatcctctcaggtgtttatcaaccggataaaggggctgaaattcaaattggtgcgagcaaatataccaaactgacgccacaagcttctattgaacagggaattcaagtaatctatcaagatttagccctttttcctaatttaactgtcgctgaaaatattgcaataaatttacatcgaaaattaggttgggtcagccaatcagaaatttatcaagttgcattaaacgcaatacaaagcattaatgcagatttagatctcaatgctattttagaagatttaccaattgcacagcaacaattagtcgctatttgtagagctcttgcacaaaatgcccgactgttaattatggatgagccaacagcatctcttacagcgaaagaagtacaagatctgctaaaagttgtactcaagttaaaaagtaaaggcattagtattatttttgtcagtcataaattacaagaagtaatgagtgtctctgataccgttttagtacttaaaaatgggaatatggttggacaataccctattagtgaaatggatgaaaaacgcttaggattcttaatgacaggcttggaaattgactataaacggttagatttgcccgatttttcgcaaaatagaaccgttttagaagttcaaaatttaactctgcctaaccagtatgaatccattaatttctcattaagagaaggagaaattattgccttgaccggtttactcggctcaggtcggacggaactgtgccttagcttatttggaatcactcaacctaaatcaggtgatatactattaaatggtgagaaggttatatttcaaaacaaccgtgatgctattaaacaaggaattgcttatgtttctgaagatagaatgacaactggtttaattatgactgaatccatacatcataatattatctctactatttttcataaaatcaccgataaatttaacattataaaatcatcaaaagcctataattatagccaggaattaattgaatctttaaaaattaaagtaacggattcagatttgccagtaaatacactttccggtgggaatgcccagcgggtgtctatcgcaaaatggttagcaatagatcctagaattattattttagatgctccaaccattggggtagatattgcgaataaggaaggaatattccaaattattcgcacattagcacaaaaaggtatcgctgttatttttgtgaccgatgaggtagaagaagcatactacaacagtcacaaagtcatagtaatgaaaaaaggtaaaattgtaggtgagatattacctatctataccacagaaaaatcaattgcggaggttgtttatgaaaatcaccaataatcatattttatctacgacaattttgatactggcaaccttattaagtctattcacgaatgacttcgctaccattgagaatatctatgatgtagtcaataactattcaatgctaatgattttagcttgtgggttgtttgtggtgttactatcaggtggcattgacatctcatttcctgctatcaccattatttcacaatacattatggtaacggctataggcaaatatgatatcggttttttcggcgtatttgcagtatcatccgcaataggtatcttacttggttttattaatgctctttttgtaaaccgccttagtgtaccttcaattattatcaccatctcaacattaaatattttctacggaggactactctattttaccaagggtgtttggttatacgattaccctgaatggttcacccaagaattgctatttttcaaacaaacctcgcaagatggttttgaattcggtttatcttttcaagcgataatggcgattttatctatattattaacttggttgatcactagcaggttaacaataggaagaaaaatttatgcccttggtggaaaccaagatgccacctctcgtattggttttaatattttattccttcacctatttgcttacggctatatgggatttatggctggaatggcaggtgttgtgcaatcttatacagtgcagtctgtcgcccctgactctctacttggttacgaattaattgtactagcagccgttgttttagggggggcaagtttatctggaggaaaagggacattatttggcactgtaatgggagtaatgttactagcaattattcaaaatgggctgaaccttatgaatgtatcctcgtattggcaaacgataattaccggtatcattatcatcttaagtattagtgctactgcattagggcaattgaaaaaacaaggagtataacgatgagaagcaaatttgatcatactattttttatctgttggctctttttattattactgttattgcctttagtattttaattccagatattttttggtctgtgagtaactttcaatcaatggcatcgcaaattccagtcttaggaattttaactcttgcaatggcattacctatgcttacgggaggaataaatctttctattattgccagtatgaatgcttgctcattaattattgcttgttttattacgaagcatgctgggatttcttggctatttctatctattgtattaagctttttatgtgcattaattattggggtgatcaatggtgcactgattgctattatccgagtttcaccgattctagccacgttaggcacaatgacattaattaatggcataaatatattagtaacaaatggttcaacggttgctggctttccagaaataatactgagtattaatacctcaacttttttatggttgccactgcctattctgatttttttattccttgctggacttgtttggtttttcttagaaaaaacttctatgggtaaagcggtttattttatcggtaataatgaaaaagccacatattactctggcattaataccaagaaagttctaatttggatatatattatctcctctgtactctgtgtattcgtagcccttttaatgatgtctaaactcaactcagccaaagcatcgtatggagattcttacttgctcatttccattttagcggcagtactaggtggatttaatcctgatggcggcaaaggaaaacttatcggcattatgttagctcttgtattactacaggttattgaaagtggattaaatatgttaggtatcagtagttatattacgatgattttatggggtagcttattactactgtttatattcttacaaaaaaatcgtcttttcctattaaaaaactaagggatgtacgttatgcaaaatgaaaaacagcttattgaacaaggtaatatcgttattggtattgaattaggttcaacccgaattaaggcagtattaattacctcagatggtactattttagcaacgggtggagcagattgggaaaataggttaattgaaggagtttggacataccatcagcatgagatatgggaaaaactacaagcggcgtatgtagatttgagtaagactgtaaaagcaaaatatcacaccacaattcgtactgcaaaagcactgggaattagtgcaatgatgcacggttatttgccttttgataaacagggaaatcagctggtgtcttttagaacatggcgaaacaatataactttaaaatcatcggaaaaattaaccgcactttttcaatatccaattcctcaacgttggagtattgcccatttataccaagcattactcaataaagaaccgcatttatctgaaattgattatattacaactctctcaggttatgtgcattggcaactaactgagaacaaagttttaggaattggagacgcttctggtatgttcccgatagatactgagatgcaatcatacaataaaactatgctgactcaatttgagcaggctattattgaatatcagatgccttggagattagatgccattttgccaaaagtattagtagctggagaacatgcgggtaaattaacttttaaaggggctaaattacttgatccaacaggtaacttacaggctggtattccactttgcccgccagagggtgatgcaggcacaggaatgattgcaaccaattgtatcaaagaaaaaacaggtaatatatctgctggtacatcagcgtttgctatgattgttttggaaaaagctttatcgaaagtctattcagaactggatattgtaactactccggcaggtaaactagtcgcaatggcacatgcaaataactgtacttccgatattaatgcttggataaatttattcggtgaatgtttagctacttttggtgtttatgtgtgtatggaagagctatatgaaatgctttttctgcatgctttgcaaggtgagccggattgtggtggattactatcttacggtttttattctggcgaacataatgttggtttatcggaaggttgtcccgtttttttgcatccaaccaaagctcgttttaatttggctaactttatgcgtacgcatttttatactgcttttggtgcaatgaaattaggaatggatattttgattaatcaagagaaagtggaaatttctcgtattctggggcacggaggtatttttaaaactgaaggggtcgctcaaaaaatattgtcttctgcacttaatattcctttagcaactgcaagcacagcttcaaatggaggagcttggggtattgcactactggcgaattttcttaccatttctaaaagatataatttagaagaatatttagataattgtattttcaacacaactaaacttaatcttattcaaccggataaaataatgagtgaaggctatgaacgatttatgcaacgttataaacaaggtatttcaattgtggaaagtgcactttttttgaatcagtaaagttacaagcacatagaaaaagcttatgttgtgacgggctgaatcggttgtagaacatctgcccataattggttaataatgttacttaactgttagggcagattgatttttacctgtatgattatgcaaaatattgtgctagatcgtcacttccgccaatatattgcccaccgataaacacttgtggcacacttgttttacctgtgattgcacgaacagaaattgtactcgcatcacgacccagtatgatttcttcaaaggtatagcccttttcttttagcaatgtttttgcttttgcacagaatggacagccgggttttgtgatgatggaaactgaaggtttttctgtccaatttgggtttaagtatttaatcattgtgtctgcatcagagactttaaatggatcgccaggttcttgtggttcaataaacattttttcgactacgccattttttaccagcatagaataacgccaagagcgtttaccgaaaccaagttctgttttatcaacaagcatgcccataccgcttgtgaattcaccattaccatcgggaattactgttacattctcgctttcttgatcagctttccaagcattcataacgaacgtatcgttaactgatacacaaataatatcatcaacacctaacgctttaaattcacatgcaagttcgttataacgaggtaaatgtgttgctgaacaagttggagtgaacgcacccggtaaagaaaataatacaaccgttttattgtcaaacaaatcggcagttgtaacatcaacccattgatctccttggcgtgtacggaatgttacttgaggaactttttttccttccatagtcataattttttctcctatataaagattagttgataaaaaatatgattttaagtttaaactatgttatagtcaaaaacaatcaaaaaaagttatttaattgttaatttctatgataggtgtacagaatgaatattcgagatttagaatatctagtttctttagctgaacataaacattttcgtcgtgctgccgatgcttgttatgttagtcaacctactttaagtgggcaaatcagaaaattagaagatgagttgggtatcgtattactagagagaacaagccgaaaagttttatttactcaatctgggttgcttttagtcaaacaagctaaaactgttttacgagaaataaagctattgaaagaaatggcaagtaatcaaggtaaagaaatgaatggaccactacatatgggtgtcattccaactattggaccctatttattaccctatattgttccggcactaaaaaatacttttcctgacctagagctatttttgtatgaagctcaaacgcaaaagcttttagaacaattggaaacaggtcacttagattgtgtcatattggcatcagttgatgaggctgaagcctttattgaagtaccgatgtttaatgagagaatgctactggcagtttcagacgaacaccctttatcaaaagaagattcgataaaaatggataagctgaaaggatatgaaatgcttatgctggatgatgggcattgtttacgaaatcaagccttggattactgttttgctgctggggcaaaagaaaatcagaattttcgtgccacaagtttagagacattacgtaatatggtatctgccaatacaggtattactctcattcctgaactggcactcttaaacgaaggttcgagaaaaggaataaaatatctgccatgtttctctcctgagccatctagaggtatttctcttgtttatcgtccaggctctcctctaagagggcgatatgagcgaatagccaataaagttagtgaaataataaaaccgttactaaacaatagaaaaaacggtaattgatatatagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttttcaataaatcacgaatttctgttagcaatttttcttcgtttgaaggtgtaattaccttttctacttttggttcttctttcttcaatttatttaatgctttgatcattaagaaaattgcaaatgcaataatgataaaatcaaatatattttggataaacataccatattttaacgtcatagccggagttttatcggttgcttcttttaaaacaatatgtaagtctttaaaatctacgctactggtgaaaaaacttaatatcggcatgatgacatctgctactaatgagctgacaatcttaccgaatgccccaccgataatcacaccgacagccatatcgataacattgccccgcatggcaaactcacgaaattctttaataaaactcatcacatactcctaaaataaacaaatataagtttgaatagatcgtaaaaactttcagtttgatgtatagaaaattgatattattctctaaataaagaaagcattaggttgaaaaagtttctctatttctgttacatattttttatcacttaaataaacaatgatatgatcgccactttcaatgactacatcttttcttgcgatgatcacagtatcttgtcgcaaaatcgcaccaataattgcaccattgggtaattttaactctctaagtttacgtccaattacttgtgatgttgtttcatcgccatgcacaataatttccaatgcttcagcaatgccatgacgcaaagagatcgcatttgcaatatctcctttacgtacatgccccagtaaagcggagatggtagcttgttgtggagaaactgcaatatcaattgttccgccttgaactaaattgatgtacgccatacgctgtattaacaccattgcttttttagctccaagatgcttagccaagaatgccgacataatatttgtttcatcatcactggttaaacataagaaagcgtcaatgttttcaatatgttcttcaaacaataacgatttatcggaaggatctccatgcaatactaaggttttagataatttttccgcaagtgatgttgcacgctctgcattacgttcaataagtttgactgtgcagtgattttccagtttttttgcaacacccacggcgatattacctcccccaataatcatcactcgtttataaggtttttccaagcgttgcagttctgacatgaccgctttaatataaattgttgcacaaataaaagttacctcatcgccggcttcaataattgtcgaaccctgcggacgaatcactttatcttgacgcaaaatagataaaatacggcaatcaatatgcggcatatggtcttttagggcggaaagagaatagccaaccaaagggccaccataataggcttttactacaacaatactaatattttcattagctaaatgagctacttgtaatgcaccggggtaatcaattaagcgagagatttcttcagtaacaagttgttccggtgaaatgatatgatcaatagggatcatgtgcggttgaaataatttatctttttcacgccaatattctgcatcacgaatacgtgcaatttttgtcggagtgttaaataaggtataagctatttggcaagaaatcatattcgtttcatctgaacttgtaacagctactaataaatctgcgtcaggtgctcctgcttctcgtaaaattctcggtgatgatgcagagccgttaatcacttttaaatcatgtttatcttgtaaatgtgccaaacgaacagcgtcattatcaattaacgttatatcattgtcttcactcactaaattttcagcaagtgttgttcctacctgaccggcacccagaataataattctcatcaattccctcttttaatttatacagattgaatacctttatttttcatatttcaacttcacattaatttctgataagttttatgattaattgggcagttttcttaatttggcataataaaaaccgtcacctccctgttctgttggaacaaattgatgaccaatttcctccccaatggtaaaaggcaaaggttctaattttgcatcattgtgcttggctaagaaatgctgaatttgttgactattctcttcaggtaataaagaacaggtcgcataaactaaaataccttgtggttttaattttttccaaagggcttctaaaatttgtccttgcaattgcactaggggagtaatatcactttcttggcgtagccattttatatcagggtgtcgacgaataacaccggtagcggaacaaggagcatctaataaaattcggtcaaattgtaccgcactttcagatttaaaggtcagtcctatagcattaaaatcaatctctgataaccattgctccggctgggttgcatcaccacaaattattatagcttgttgtttcatacgaactaaattttctttcacacgttgtagacgagcaggttcaatatctaaagcgatgacttttgcgttgggtgcttgttctaaaatatgtgtagtctttccgcccggtgccgcacaagcgtctaaaataagttcgtcattttccggttcgagtaataaggctgaccattgtgcgtgtagatcctgaacgctcacccatccttgttcaaaatagggtaataaattgaccgcacttgcgtgatgtaggcgtaatgcttgtgggtgattcgttgttgatgtagatattcctcgctccattaaaagttgttgataatccgcaatagaacaatgttgtaaattaatgcgtagccacatcggaggtttttggttattcgcttcaacaatttcacgccaattggcataagattgttttagtttattcactaaccattccggatgtaaggtttgccaatgcttatccactatcgccagaatttgttcttgttcccgcaaaaagcgacgcaaaacagcatttaacaggccacggaaactatctgattttaaacttttcgtggcagaaacgacttcgtccactgcagcatgagcaggaattcgggtatataaaatttggtataaaccgaccaacaacaagcagtgcacgatccgagttttacctttcaaaggcttatccagtaggagttgaatgatgcgttctaatcgaggtaacacacgacaaataccaaaacaaatttcttgtagtagcggaaaatcttgcggtttgaccgcactttgttgctcaggcagcaaggtagaaagagatttaccttgaactaaaacttgtaaaattacttctgccgcaagcacacggactgagcgaggcgtgaaaagtgcggtagatttgaccgctcttttagttttgttgtgctgagatttgctcataggacttgtcctatcttaaaccaatccgcacggctgtttaataaatctcgtgctgacatcggttttttacctgcaggttgtaattgctccaagtttaatacaccatttgctgtcgctacttgaatacctcgtttatctgctgcaagaatggtgccacaaggcttatcttgatgaggtaacactgaggcttgataaacttttaacgtttgtagcgtgccttgactgtcttgtgttacaaaataactcattggccatggattaaacgcacgaatacaacgttctaattgttcagcggataaagaccaatccagtttagcctcttctttagaaagtttttctgcataattactcagactttcatcttgtacttccggtttaaatagaccttgttctaaaccgtccaaaacctcaagtaaggcttttggtgcaatgttagccaatttagtgtaaagggaggttgaggtttctgtcggtgtaatatcacaacagactttatgtaacatatcgcccgtatccagcccctcattcatttgcataatggttacccctgtttttttatctcctgcccaaattgcacgttgaataggtgctgcaccacgccaacgaggtaaaagcgaaccgtgtacattgagacaacctaaaggaaatgtttgtaacacagccaaaggtaaaattaacccataagcaacaactaccatcacgtcggcattcaatttactcagattttcttgcacctcaactttacgtaaggatttaggttgataaacgggaatatgatgtttttcggctaaaattttaaccgcacttgcccgcaatgtttgccctctccctgcaggtttatcgggctgcgtgtaaacagcaaggacattatgttgagattggagtaacgcttgtaaatgttgtgcggcaaaatctggtgtaccggcaaaaataatatttaatggtttcataagataagctaatgttctacgttatgtaattgataaaaataaaaggcggacaatccgtccacctattgtttaatttaacgattttttgcgatttgtttttgcaatttgagtagtttttctttcatgcgttggcgttttaatggcgacaaatgatcagcaaaaacaataccatttaaatgatctatctcgtgttgaatacaaatggccaacaaaccatctgcatctagcataaactcttctccctgacgattttgtgcttttacttttacagtctctttacgaggcacaaaaccacgtaaaccaggtaatgataggcaaccttcttcaatacctgtttcaccgaaactttcaagaatcttagggttaatcaacacaatttgattttctttagttccttcaatatcgatcgtgataatacgcttatgtacatttacttgtgtcgcggctaaaccaatcccttcttcgtgatacatcgtttcaaacatattatcaataaaggtttgtaattcttcgtcaaaaacgcttacaggttctgcgaccgtttttaagcgttcatcgggataaattaatacattcaataatgccataagttcctttcatattttatgttataaattcaaattgaattcattttactcgtttttataggcttttttaagaaataaaataaggaaatgggaaaatatctcaactgagatgtgtaaaaaacttcagcgagagcgatttaccggcaaaagagcggtaatttctaccgctcttttttgggagttgtgttatacgcctttatgctggaagtacaaaactgttgcggcaacccgagaatgaacgtttaatttacgtaataaattgcgaatatgtacttttaccgtttcctctgaaataaataattgtcctgcaatttgtttatttgctaatcctgtcgcaatgagtgccagtacattcatttcccgatctgtgagggaataaataggatcatctttatgttgacgttctaacagtaaatttttgatcgattcactgagaatgacttcgccttgtgtaactcgttttatctgagagagtagggtatccggttccgtatcctttaataaataaccgtcagctcctgcatcgattaatgtgaaaatatcatttttcgcatcagaaacggtaagtattagaattcttgcatcaattccttctgtgcgtaaagcctttaatgtatccagtccggataatcctttcatatttagatctaaaatgatcaaatcaggttctaactgcaatgccagatttacaccttcacttccacttccggcgtcacctatgacttcaaaagattcatccagctcaagcaattgtttaatacctcgtcgcatcaaaggatgatcgtctattaagagcacttttgttttatcagacattgattttgtcctcatcatgagagtgcaaggcggctatgaaaaggcacgatttttgttccaccgttgcagtctggtaataattgataaaattgcggatagttaaaattatgctgcacgattttatatgggttgttgtttttatccaagctcgccgattgataaatttgatttatctcacgaattttctgttcttttgagccttcacaatgtcgatagatttcaatgtggttttgttcgtctaaaatatagacattaaaacttttatcttcattatcttcaaagaaaaattgtaagaaaccttcgcttgcaaaagcatccatttcataaggataatgtttctgttctgctaaaagtgcggtttctttttcctcaatagtattacgtagttcattatcaaatacactattatttatcgaagtgttttgcatttcctgtaagctgagtccacgctcttcaaagaataattgccagtttttacccgctattctcaacatattatttttgggggcatcggtatcaccaattcgtatatcaatatattttttgataagtgcatggacaatattgcataaggttttttggtagtgttggctgtaacaaaagacgttaattgattttggcggtgttgagccgggataaattttgtttgataacacttttaatgctaatagaatggcattggcaccctcaaaatgcaacgtgcggatctcattccagatatttctataagtgaggtcaatacttcctacgagactttcttctgaaggcccaaaactgaataagtcacttggtaaaatagtcgacttactttgcaacaaatgagcagttggatcgttagttaaattgattgtaacggagagatgttttattttgcattgttgagttaattccttatttgttgcttttttagtacgggtaatagggaaagataaacgcaaatcagcaacgaaattacgtagcgttttaagagatacagtatcactatgaatataaagcgaagtgattggtgtaagcaacccattaaaataggcccatgaaactaatttatttagattttcgccatattctatgtggcgtttttgacaaagtccttgtacatccggtttttgtgttactaaataccaaccggctttgaagaatttattttgtttcacttcaatgaatgttaagtgcggttccgataaatcaagagaaatagcttgattgagcaaggtgatttttcccggtaattcttcaaaagcggtgtaaagttttctggtcaagatagaaacatcttgtggcatgatactggcatttacattatgtttacgcccgaagttaattagatttcgatagctcaacataaggtattgcatcaggtcattgtgactttccttaacttttttgattttccaagttgtacgttgatttagattttgaagaagattatctgaccaattccactgctgtgtaagttgatgcagtttttctgaacgccaattattttcttgttgttgaacgatatactcactggctttcatataaaagcaacgtctcacaaaatctaatcttttgaattcattcagttttgttaaaaaagaactcactcgctccaacattgctaagtatgggtcatagtgatagtcaagatcgttattcagcagacgttgtttgaattcttgtgcaattaagtgagtatttggatattcataagaataactttcgagtaataagattttgagtaccgatttatagggggaatcgatacctttatatagttgccatagacttgcaccaaaatattcgttcgctgaaaacgcactcagacaaccaaaatctacccaatcatctatattgatttgctttgttttgatgagtcgattgacttcagaactataatcttgttcatttgctacctttagatgtaaccaaagtagcggtttaccggcaaggcgaataacagaacgatagaactcctccagtaataacatatattgtgcggagccactattttcagaagtaagtgcatcggcataacgaaagctacgaaaacgctgttggtcaattaaataaagattaatttctacgccaagacttcttgcccattgttgcaataagtgatttttttttgaaagttgttctttatcttctaagctaagatcttctcggtggcatacccaaatatctaaatctgagcttggtgtttggctgatagaaccgatacttcccataacgtaaacacctaaaataggcgtgtctgtgagatgttgtaatgccgccaaatgtgtactaagttgctcaaaatcaccctgagggagatgtgtagttaaaaattcctgttggtattttgataattgaaaacgagcaatgccatgtggggcattcggtaggtaaccgcccatcaagggatgatttatgtgtaacaataaggtaagaagttgtaatacacgttggaactctactgaagttgaagatagtgctctttctaaacgtaactgatcaacaaattcaacttgtttcttcgcttgttggagatcgtatttcaagttattctctatctagataaattaatcgttgcttactctatcactccccttgtatgaaagcaaaaaaatcgagtaaaaaattaaatctacactgacatttcagagtaacagtgataggatattgcgattacgagtctaatctatatttctacatatgagtatcaacaagaccctaaaaattgcgacacgtcaaagtccgttagcattatggcaggcaaattacgttaaaaatcgcctacaacaacgttattctcatttaagtgtcgaacttgtccctatcatcacaaaaggcgatgttatcttagatacacctttagctaaaattggcggaaagggattatttgtaaaagaattagaaaatgcgttgttaaatggtgaagcggatattgcggtgcattcgatgaaagatgtgccaatgcaatttccgaaaggattagagctaagtgtgatttgtccgagagaggatcctcgtgatgcatttgtttcaaataagtaccgcactttagacgagttaccgcaaggtgctattgtaggaacatcgagtttacgtaggcaatgtcaactcaaaaactggcgagcggatctcgatatccgttctttacgtggtaatgttggaacaagattaaataagttagatcagggtgattatgatgcgattatcttagcttcggcaggattaattcggttaggattgactgaacgtattcgctcttttattgaaattgatacgattttacctgcttgtggacaaggtgcggtaggaattgagtgtcgggtagatgatcgagatgtgcaatctttattgatgccgttggctgatcagacgaccacttattgcgtattggcagagcgtgcaatgaattttcatttgcaaggtggttgccaagttccgattggtgcttatgcaattttagagaataatcagttatatttgcgtggtttagtgggagatgttcacggttcacaaattctatcggcagaagggcaatttgaattatctcttgattttgaatcatcgcaaagtgcggtgcaaaaagcggaagaattaggcgtgagtattgctgaacaattattacagcaaggtgcagataaaatcttacaggctgtttatcaatcataattgagtaagaggcaatggcagttttaattacacgacccggtgagcgaggagagcgacttgttgagatgcttaataaagccggaattatggcactccatttaccgcttatttccattatagcggggcaggaattaaatcgattacccaataaattacaacaattaaattgcggtgattatgtagttgcagtatctaaaaatgcggtggaatatgcacaaaaaaccttaagtgcggtaggtttttgttggcgttcggacttatattactttacggttgggcaacgaactgcagaatattttgcgagccaaatagaaaattcggtgtattatcctgttgagcaagaaagtagtgaaggattacttaatttacctcaaatgcaagaccttcaggcacggaatattttgattttgagagcgaatggaggacgggaattttttactgagcaggctattttgcgaggagctaaagttgaaactctggaatgttatcaacgaatgcccattgaatataataagttggaaaaaattagtttatgccaacgtattggggtagataccattgttgtaacaagtcaagagatgctaaattacttagtgaaacttgtgccaaccaatgaaacaggctggttattcagttgtcgtttagtaacggtaagtcaacgtatagcggcattggcaaaaagtgttgggtggacaaatattgttgtggcagataaagcggataacttgagtcttttccttgcattgcaacaatgaaggctggaatttcatttgattaaggaataaaaattatgacgaagaaacattcaaaggttagcacagaaaaacaggataatatatccgtgcaaaatcctcctttggaggcagaattgcaatatgaggaagtaccggctgaggatattgtaaagcaagaaagtaaggctaaacaggaaactttttcaaatcaggagcattttatggaaagagagaatgaacaagttggcgaaaaaagaacagcagctcaagttgaaactgtagtggtgaaaaaaggaggggcagtcattgctctattagctttgcttattgcattgggtattgggggagctggctattattttggtcaacaaaaagtagaagaaattcagcaaaagttgaccgcacttagccaaccgtcggaagctgtgccgctagaaaacaatgatactttgttggtaacagttgaagaatataagcaaacttttatacagaagattgagcgactggaaaatgaaatgacaaaacaaaaccagcttattcaaagtttacaagcacaagtaaataaattggatgcggttggtaaagttgaacaatcgacggattggttgttgtttgaaacagattatttgttgaataatgctttacgtaaaatcgtattggataatgatgtggagacagctattgcgttattgaaagtggcggatgaaactctcgttaaggttaatgatcctaaagtcattaacattcgtcaggcaattaatgcagatttaaaacagttattatcagtaaataatgtagatcaaaatgccatcatgcaacatttatctcaattagcaaacggtattgatgaattagttgtattaaatgtgaatttcgatgagcaagaaaatactcaattaagcgattccttacaggattggaaagaaaacgtagaaaaaagtgcggtatcttttttaaatcattttattcgtgtaaaacctcgccatgtgaactcaaaggaattacttgcaccaaatcaagatatttatttacgtgaaaatattcgtttacgtttgcaaattgcgattatggcggtccctcgtcagcaaaatgatttatataaacaatcacttgaaattgtaggttcttggataagaagctattttgatacaagcactgaagtggcacaaaacttcttgaaagagattgatgaacttgctgagaaatctatctatgttgatgttcctaaccaattaaaaagtttgcttttgttggataagttattgaataaggaacagtcatctgtacaaaaaattgaaatgacagtagataaagacttggttagctcaacagatcaagtatctgaggaagggaaaacagatcaagctgttgaaaaatctgatgaaaagccaattgaacagcctgttgagcaagcacagtaataggagaatagcgtatgttcagagttctatttttaatgctggttttattggctggattaattggcggtccctatttatcaggtaaacagggatatgtgttaattcaaacggcaagctataacatcgaaatgtcaatcacgatgttggttattttctttgtgattttaatggccattgtttatctgattgaatgggtggttacacgtttcttccgtttgagtaataatacctatagttggttctctcgtcgtaaacgtgttaaggcacaacgtcaaactttggaaggcttagtgaagatgaatgagggcgattattccaaagctgagaaattgattggaaaaaatgctagacattcagataaaccaatattgaatttaattaaagcggcggaagcggcacaacagcgaggcgatgattttgttgccaatcgctatttaattgaagcaacagaattagcaggtacagacagtttaattgtcgaaattgcacgtactagaattttattgcaacaaaataaacttccggcagctcgtagttcggtggatagtttactggagatgacctctcgtaataaagaagtattaaagctggcagtgaaaatttacctgaaatctgccgccttccacgcattggataaaattctagatcaaattgaaaaagttggattatattcttccgatgaattcaccgcccttcagcgtaaagtcgaagatggtttattagacgagaaaatgaacgaagagggtgttgatgggttattacgttggtgggatgaacagcctcgtaaacgccgtaatgatttatatgttaaggttggtttaattcgtcgtttactggacagtgatgatcatgaaagtgcttatgagttagctattgatgctctgaaaaaagttgaaaatagtgttgaagctaatgttgctctttgtactcaaattactcgtttacaaccggaagataacagtaagttattaaaacttttggaaaaacgtgcaaaacagtcaaacagtaaagattgttgctgtgttgaacgtgcgttaggttacctttatgtgcgtaatgatgatttcgctaaagcggcagaagcattcaagaaagtgatagagaataaagcgagcttacaagcaaatgatattactatggcggcttatgttttcgaacaggttggagagcttgaattagcacaaaaagttcgtgaggaaggattgagaaatgcgatgtcaattaaagagtcggaaaataaaaccaaaaaaacagcagaaaatccgaccgcccttttagaacaaaaatcctaaatatattgttaaaaatgcccttaaaaatcattgttaagggcatttttataggttttatttttcctcaatgaaagttaaggctttttcaataacctccacaccagcatgagatttatggatgttttcactcatatagcgtctccattgccttgcccctttacattgttgaaatgcacctaataaatggcgagcaatatgattaagataaacgccttgactcaattgttgctctatgtaaggaaacatattttctattgcttgtcttggcgtgataattgcacaagacggatcaaataacgcttgatcaatatagcccaataaagacgggttttgataagcttcacgcccaaccattactccgtccacataattgagatgtcgttgaatttcttcaagcgttttaattccgccattaatgctgatcaataaatcaggaaaatcctttttcaactgataaactcgctcataattaagtggcggaatttcacgattttcttttggacttaaccctgatagccatgcttttctagcatgaataataaattcttggcaaccgatattatgtactttttcgataaaatcacatagaaattcatagctatcaaactcatcaataccaagacgtgtttttactgtgactggaatattgaccgcactttgcattgcgttcacacattctgctaccagatcagcccttgccatcaggcaagcaccgaacataccattttgcacccgatcggatggacaacctacattcaagtttatttcttgatagccacgttcttcagctttttttgcacaatattgcagtttttcaggatcacttccgccaagttgtaatgccacggggttttccgatacatcataagcaagatgatcgtatttggcgtgaataattgcaccggtagtaaccatttctgtatagagtaaggtatactggctgaactgccgatggaaaaaacggcagtggcgtgtagtccagtccagcataggagcaacggaaaaacgacctcgataaaagtgcggttgattttgcttcattttttacttgtttgataattgaaacggttagggtttagcgttttcgtgagcttttctctttttgtgcatgccgacggaaacgcccacgcctaaatgataaagtaatacaggattaatttggcgtgaaacaaaagccgttacaatacaatcaatgaatgcttaaatcaagccaatttgatgagttgttattgttggtttaaggattgcgtacttaccactcaatatctgagctaatacggtatgtctaagagggaataatcgggttattgcttagatttaatatgaaaggtaatttcatgaggtgaagaaattccggtagattttagtcacttgactggaaaagtgaagtagcaacgtaaagaaaaattggtacactctttttaagtttacgttgctgtcgttttagatatttatttaatcccaggagctttccaaagcgaaatggttagtcctctgtcaaccaatttcaattgctgctggtatatttcttgccatttttctttatgtatttgatataaattatgatttcttgcatttggttgatgttgtctttcaaattttactaatgttttacctgcttcatgtaatgaagtataaataccagcacctactccagctgcaatggcacatcctagagcagttgcttcttttactacaggtacattaacaaccaatcctgttacatcagctagaatttggctccataatttcccttttgcaccacctccggcaaaaacaatactggtaagattaacgtggctgaattgctggacttgatcaagattacatgaagatacaattgctgcattttcttgtaatgccctaaacaggactgatttgttacatttttcaggatcaatcgaaaggttaataaatgatggggctgcgtgataccaagatttgaaatgcatagcatcagagaatacaggaataacatcatttgaacctacgggtatcttttctgccatttgttccagtaatgtgtaagcatcaacacctaagcgatgagcgacggctttttcttcttcacagaaagcatctctaaaccaacgcatagtaagtcctgtaaagaagctgatagattctgcttgtaccatcggtgcaatgacatgcggattgatgcgtatattcattttaggatctgtcattgcttgtggtaagtttacgacctgttgccagaaagttcctccaataatagcagcttgccccggttctgtaatccctagtccgatacaacctaattgcacatcaccaccaccaacaacaacaggcgtgccgactattaacccagtttgctgtgcagaatgggcggttacttgaccgagtatttcacctgtctcttttactttcggtaaaatagcaggattgagtccagccatctctagtaaagtgtgctcccattttcgggtttttaggttgagaatgccggttgtgccagcatttgaaggttcgacggccagttctccgctaagcataaatcctaaccaatcgttaatcatagagagaaaatggacttgagcataaagattaggttgatgatgtgcaagccaaagtaaacggggtaatgcacttaatgccagtgtttgaccggaggattgataaacttgttgttcaaactgatactggtttagagactttaattgaataacttcttctacagatctggcatccacattaccgcacgcccaaatcgggtttttattggcatcgtataaaacaatgccttcacgcatagagcaagtcgatatagctataatttgtttagcatctatttggctggtagctaaaacttcttgaatacataagcaagcaaggtgccagttattttgtaaatcaaagcccattgagcctgggatatttgggtcggaaatatgtgtccattctttttgtgacgtagcgatttgatttccttcaagatcaaaaataactgcacgaatactacctgtgccggcatctaatgccattaaataacgggataattgcattatgttttcctccgattatctgaggaaaatcgttacactactttagctaaaatagtgcgtgcggttttttcctctgtgactaatgaattgatatgctgtcctaaaagtgcggcaataattgcttcaactttatcttcaccaccggcaacgccaataatagtcggtattcgcttgatactatctaatgaaacgctgattaattcctcgtgaatcggcatatccggttgaatgtttccattttcttgcaagaaatagcctaaaatatcccccacagcacctttttgacgaaattcatctagttgtttttcattgatgatataacctgtttgaagcaaagtggagcgtgttttctgaaccgtagatccgataccaacgatggcaacatcagccatactggctgctaacataatatctcgtacatacccctctttttggaaaagttgtgcagcttcaggtgaagaagctcgtagaggggcgggaataatactgatagcacagctactatcaagttgcccaatactttgcatataaggtccaacaccgccggttaaggtgattaacttaatctggttttgtttaataaaatcattgcagtgctttaccgtgtgcatcacggtgtcaccaaacccaaaagagagaacttgctttgctttgagtaatcccatcaacatttgagaggctccgacacctaagcgggcattgacttcataattctgtaactctggcaacacacgaatatgctgtaaatgaaaccgctgttttaaagcttcttctagttccaagcatcctttataacgagagttgatttgaactttgattaagccgatttgtcgccctttttccagtaagcgtgaaacttttaaacggggcaagcccaatttctcaccaatttcattttgtgtcagattatcgtggtagtagaaccacgcaatgcgtgctaatagctcttcctcgttaaagccagcttcgtagtgattatctaaatttatcatttttttaccctgtttttattattcatctgattttaattttaatcaaatgttctttttctaaagtgtgaattcgatcacattttacatttaatgtgaaaaaaagacataaaattcttaaaaatgtgaagtttatcacaaaaaaatagaattttttgggttatgatttggaacaaatgataattaaaattttcatttgttcaatttgaagggtcaaaaatgaaagagacagaatctaatcctacgcctttactggaagcttgtgatgtaagtaaagctttctctggtgttgaagtactaaaatccattaacttttccctttattctgggcaggtacatactctactgggtggaaacggtgctggcaaatcaaccttgatgaaaattattgccggtattcagttgcaagataccggcacgttaaaaattcatggcaaagtccgaaccaatttaacgccaagcaaggcacatcaattaggtatttaccttgttccgcaagaacctttgttattttctaatttgagtgtcaaagagaatattttattcggtttgccaagaacaatggatttacagtcaaagctcacagcgttgttgacggaactaaactcacatttaaatttggatatgcaggctggtttattagatgttgctgatcagcagttagttgaaattatgcgaggcttaatgcgagatgctcagattctgattttagatgaacctaccgcctcattaacaccagtggaaaccgaaaatttattcggacagataaattccttactcgtcaaaggggtagggattgtttttatttcgcataaattgtctgaagtttggcaaattgctgattgggtgagtgtaatgcgagatggttacattgccttaagcgagccaattgacaagatcaatcacgacgatgttattcaggcgattactcctcgagctaaaaatgcatcattaacagaaagtcagcagttgtggttggatttaccagggcataagagggtgaaatcgaccgaatttccattattgacagtagaaaatttcactggtgaaggattccgagatatcaactttgaaatttatcctggcgagattttaggattagcaggcgtagtcggctcaggtagaaccgaattagctgaaacgctgtatggtttgcgtaaagccaaatccggtaaagtgatattttgtgatgagctaattaattcactgtccgttaagcaacggcttaaacgaggcttagtgtatttgcccgaagataggcaagcctctggattgcatttggattcaccattaagttggaatacctgcggattaacctatcatgatatgggcttttggattgatgagtccaaggagaaagcaattttagaacgctattaccatgctatcggaataaaatttaatcatgttgagcaatcggtacgtaccttatcaggtggtaatcagcaaaaaattttgatcgcaaaatgtctggaagccgatcctcggttgttgattgttgatgagccaactcgtggcgttgatattggtgcgagagcagatatttatcaattaataaaaagtattgccaaacaaaatgtagccgtgttgttcatttcatctgacttggaggaaatagaacaaatgtctagtagagttttggtaatgcacgacggtaagcttagtcaatcgttgaaaggtgaagatatcaatactgataatattatgcgactggcattcagtagttaggaggcattatgtggaaatttattcagaacaatcgtgaattaactattttagctgccattttgttgttatttggattgctaggtgtggcggatgactttagcttacaaactctcatgatgatttttaactcgacccaaatattagctttgttagctattggtgcgacctttgtgattttaactcgtaatattgatgtctctgtcggctcaattatgggattaagtgcagtagttgttggattagtgctaaattcaggttattccctactgattgcgtgcactattactttactgtgcgggattattgcaggtggggtaaacggtgtattggtctcagtacttagaataccggctattgtggcgacattggggacattaggtttatataaaggcttaatgttagtattaactggcggtaagtggattgaaggtttgccacattcattgaaaacattgtcagaagaaattttattggggttttcgcctattgggttagctgttcttttcctcattttagtcacgtactacttttttactcacacttatattggtcgttgtttttatgcagtgggggataatttacaaggtgccttgcaattaggtgtaaaggtgaatgttattcgcgttagtgcatttgcagtaaacggtctaatggctgctttagctggaattatttttgcttctcaaatcggttttgtgccaaattcaactggtaatgggctggaaatgaaagcaattgcggcttgtgtattaggtggaataagtttactgggtggtgcaggtaatattattggtgctgtattaggggcatatttcctgattcaaattgatacgattttagtactgatgaaagtgcctgcctattggaataactttgttgctggtgtggttctattagctgtattggtatttgacggtagaatccgagtaatgattgtcaataatatcaaacaacagcgttatgcccgttttcttaaagataattcattgcaggagaatcaaaaatgattaagaaatacagctgggaaatagctctcttttgtctactgatactggaaattatcgggttcggtttggttaatcctcggttattggatctcaatgtcttatttaacagcaccagcgattttatttatatcggaatgttagcattgcctctaacactgattatagtcagtggagggatggatatttcatttggatctgtagtggggctatgtgccattactctcggcgtattatttagactaggaataccgttaagtgtagcaattgcggtgacatttgcagtcggatcattgtgtggtgcgattaatgctgtactcattatctatactcaagttaacccgctggttattacgcttggcacaatgtatctgtttggtggtggtgcattgttattatcaggttttgctggtgcaacgggctatgagggtattggtggatttcccgatgtgttacttgattttgcaaatctcagttttggtattattccaacaccgattatttatttcttaataatgacatcactgttttggctgttgatgcatcgtactcgtattggtcgtagcacatttttaattgggcaaaatttacgggtctctaagtatagtgctgtaccggttaatcaaactctatttattatttatccgttaattggtttgattgcggcttttgtcggtgtgttgctggtatcctactttggttcagctcgttcggacttagggagttcgttgttaatgccggcactaaccgcagttgtacttggtggtgcgaatatttacggtggttcaggttcagtgattggtacagcaatagctgcattattgattggctacttacaacaagggttgcagatggttggaatttcgaatgaaacatccagtgccttgtccggagcattgttgattattgtacttatcgggaaatcgcttaatacacatcgggcagtagtgattcaatggtggaatcgaatccgagcagtttaaaataagcggttagtttatgatgatttttgtcaaaattgactgcgataaaacccctgcatacttgttgttttggtatgttttttaatcatacactcaattgaggagacgttctatgaaatactcacttttaaaaacaaccgctcttgccgtagcgttaggttttaccggttttaacatagcacaggctatggataaggtggcatttatcccaaaattagttggcgttggtttttttaccagtggtgggcaaggtgcggtcgaaatgggaaaaaaattaggtttggatgtaacctatgacggtccggcagaaccgagcgtatcgaaccaagttcagatgatcaataactttgtgaaccagggttataatgccattatcgtctcagcagtatcgcctgatggattgtgctctaccttaaaaagagcgatgaaaaaaggtgtaaaagtattaacttgggactccgatactcagcctgagtgccgaagctactatattaatcaaggaacacctactcaacttggctcaatgctagttgaaatggtatcaagtcaaatttctaaaccaaaagcaaaagttgcatttttctattccagtccaacagtgactgaccaaaaccagtgggttaaagaggcaaaagcaaaaattgaaaaagagcatcccaaatgggaaattgtgacgacacaatttggctataacgatgcaattaaatcgctgcaaactgccgaggggatcttaaaagcctatcctgatttagatgcgattattgctccagatgccaatgctttgccggctgccgctcaagcagttgagaaccttaaacgacaaggtacaatcgttgtcggattcagtacgccgaatgtaatgcgtccttacgtaaaacgaggcacagtaaatcagtttggtttatgggatgttgtgaagcaaggtcaactctctgttgcagtagctaatgaattgttaaaaggtaattctcttaaggttggcgataaattgaatgttgatggtattggtgaagtagaagtatcagcaaataaagtacaaggctatgagtttgaagcaaagggaaacggtattgtgttactacctgagcgtgttgtattcactaaagataatattgataactatgatttctaattatataggagacaatctatggcagatttagatgatattaaagatggtaaagattttggtattggtattcctcaaactaacaagctttttttcgtcaaaggttccggtgcattagattggggaatgcaatcacgtcttgccaatatctttaatcccaaaacaggtaagacaattatgttagcctttgatcacggctatttccaaggtccgacgacgggtcttgagcgcattgacctcaatattgcaccgctctttgattataccgatgtattgatgtgtacccgtggtattttaagaagcgttgtaccgccggatacccgaaaatctattgctttaagagcgtctggtgcaaattctattttgacagaactttctaacgaagcagttgcagttagtattgaggatgctttgagattaaatgtatccgccatggctgcacaggtttatatcggttctgaatatgaacatcaatcgattaaaaatattattcaattggtcgatcagggtaatcgctatggaatgcctgtgatggcagtaactggtgtagggaaggatatggctcgtgatcaacgctacttctcactttcgactcgtattgccgcagaaatgggggctcacattattaaaacttactatgttgataggggatttgagcgggttacagcaggttgccctgtaccgattgtaattgccggaggtaaaaaattaccggaattggatgctcttgaaatgtgctatcaagcgattgatcaaggtgcagctggtgtggatatgggcagaaacatttttcaatctgaagcaccaattgcgatgatcaaggcggtgcaagcggttgttcacggtggagaaaatgcaaaagatgcctaccaactctatttaagtgagaaaaacaactaagttaattaggttggctaagttagccaacctatttttcccacgttttctatgataaggagaagcttatgtttgctatgcttgttgaaatcaatataaaagaaggtaaagaaaaagaatttctggaggttttcgaacgtaaccatattggcactcgccaagaactgggaaatttgcgttttgacatattacgagatccggaaatacgaactcgtttttatgcatacgaagtgtatgaaaatgaaacagcactaaattttcatcggcaaactgaacattatcgccgttgtgtaagagaattagaatctttaatgactggttcaagaagtaagaaaatctttgaatggatattaccgaatccttatgtctaaattatcacttattcagcagttaaagcagcaaaagctgagtgttggtatcttatctgcaaattggcttcaacttaatgaagaggtaacaacattgttggagaatcagattaatgtactgcacttcgatattgctgatgggcaatttagttcgttatttacagttggagcaataggaattaaatattttccaacacattgttttaaagatgtgcatttaatggtaagaaatcagttggaagtagcaaaagctgttgtagcaaatggtgcaaatttagtgacattgcagttagagcaatatcatgattttgctttaacgatagaatggcttgctaaacagaaaacaacttatgccaatcaggtatatcctgtattaattggagcctgcttatgtccggaaacgccgatttctgaattggaaccttatttggatcaaattgatgtaattcaattattaactttagatccgagaaacggaacaaaatacccttccgagttgattttagatcgtgtaatacaggtagaaaagcgattgggtaatcgacgtgtggaaaaattaatcaatatagacggctcaatgacgctggaacttgcaaaatatttcaagcaaggaactcatcaaattgattggcttgtttctggttctgcgttgtttagtggagaattaaaaacaaatttaaaagtatggaagtccagtattatgtgacatcaataaaaagtgcggtgattatttcgtgatttttatgaaatagcttgctttttttgagatcatgagtataatctcaccactttcgatatgaaagtcgtttgatgtaatcatttattgaacgtactattacgatatgtaatagataaaatgtccccaatttggaggactaagtaggttcgctgcacttccctttatttaagatgttaaaggtgatggtgtcagtttttttatagctaattttattggagctctggtctaatgcagaaccaaagaatccgtatccgcttaaaagcttttgatcatcgtttaattgatcaatctacagcggagatcgtagaaacagctaaacgtactggtgcacaagtccgtgggccaattcctttgccaactcgcaaagaacgtttcacagtattgatttctccacatgtaaataaagatgcacgtgatcaatatgaaattcgcacacataaacgtttagtcgatattgtagagccaacagaaaaaactgttgatgcattaatgcgtttagatttggctgccggcgttgacgtgcagatcagcctaggttaattaagaggttattacaatgattggtttagtcggtcgtaaagttggtatgactcgtatcttcaatgaagatggggtgtcaattccagttaccgtaatcgaaattgaagccaaccgtgtgactcaagttaaaactcttgaaaacgatggctatactgcagttcaggttactactggttttaaaaaagcaagtcgtgtaaccaagcctgaagcaggtcatttcgtgaaagcaggtgttgaagctggtcgcggtttatgggaatttcgtactgaaggtgaagaattcactttaggtcaagaaatcaatgttgacatctttacagatgttaaaaaagtagatgttactgggacatcaaaaggtaaaggtttccaaggtggtgttaaacgttggaatttccgtactcaagatgcaactcatggtaactctttatcacatcgtgtgcttggttctattggtcaaaaccaaactccaggtcgtgtgtttaaaggtaaaaaaatggctggacatttaggtgctgaacgcgttactgttcaatcacttgaaattgttcgtgttgatgttgaacgtaaattattattagtgaaagggtctgtacctggtgcaactaatagtgatgttatcgttaaaccagcagttaaagcataagtctaggagatagagatggaattacaagttgtaggtgcaaacgcactcactgtttctgaaactaccttcggacgtgagtttaacgaagcgttaatccaccaagtggttgttgcttatgcagcaggtgctcgtcaggggtctcgtgcacaaaaaacgcgtgctgaagtgtccggttcaggcaaaaaaccttggcgtcaaaaaggtacaggtcgtgcgcgttccggtgatattaaatcaccaatttggcgttcaggtggcgtaacttttgcagcgaaaccacaagatcacagccaaaaagtgaataaaaaaatgtaccgcggtgcgattaaaagcattctttctgaattagttcgtcaagaccgtttggttgtggtggaaaaattcgaaattgatgcaccaaaaacaaaagtattagtacaaaaattaaaagatatggcgttaactgacgcgcttatcatcactgcaagtttagatgagaatctattcttagcggcacgtaacctttataaagttgatgttcgtgatgtgcaagctattgatccggttagcttaatcgcattcgataaagttgttgtaactgtagaagcggtaaaacaaattgaggagatgttcgcatgattcaacaagaacgtttgttaaaagtgttgagagcccctcacgtatcagaaaaagcaacaaataatactgaaaaatcaaatacgattgttttcaaagttgctttagatgcaaataaagtcgaaattgcaaatgctgttgagcaattgtttgaagtgaaagtagactcagttcgtacagtggttgttaaaggtaaaactaaacgtcgcggtgctaaaatgggtcagcgtagtgactggaaaaaggcttatgttactcttcaagaaggtcaatcgcttgacttcgttgaaggtgcggctgagtaatttcggaggagaaaaaataaatggctatcgttaaatgtaagccgacctccgctggtcgtcgtcacgttgttaaaatcgtaaaccctgaattacataagggcaagccttacgcaccgttattaggtactaaatctaaaactggcggtcgtaataatttaggacgtatcactactcgtcatattggtggtggtcataaacaacattaccgtgtaatcgatttcaaacgtaacaagttagatatcccagcggttgttgagcgtcttgaatatgatccaaatcgttctgcaaacattgctttggtgctttacaaagatggcgaacgtcgctatattttggcacctaaaggtttatcagcaggcgatcaaatccaatcaggtattaatgcaccaattaaaattggtaattcgttaccgatgcgtaatattccggttggttcaacagtacataacgttgagttaaaaccaggcaaaggcggacaaattgctcgttctgctggtgcttatgtacaaattatcgctcgtgaaggtaattatgtgactttacgtcttcgttcaggcgagatgcgtaaagtattatctgaatgtgtagctactattggcgaagttggtaattcagagcatatgcttcgcgtacttggtaaagctggtgctaaccgttggagaggtgttcgtccaacagttcgtggtacagcaatgaacccagtagatcaccctcatggtggtggtgaaggtcgtaacttcggtaagcatcctgttacaccttggggtgttcaaaccaaaggtaagaaaactcgtcacaacaaacgtaccgataaatatatcgtacgtcgtcgtggcaaataatattaattaaattaagaggatatgccatgccacgttctctcaagaagggtcctttccttgacctacacttgttgaagaaggtagagaaggcggtggaaagcggggataaaaaaccaattaaaacttggtcccgtcgttcaatgatcattccttcaatgatcggattgaccatcgcagtccataatggtcgtcagcacgttcctgtttatgtttctgatgaaatgatcggtcataaattaggtgaatttgcaccgactcgtacataccgcggtcacgctgcggataagaaagctaagaagtaaggggtaagagatggaaactattgctaaacatcgttacgctcgcacttcagcgcaaaaagctcgcttagttgcggacttagtccgtggtaagaaagttgcacaagccttagaaattcttactttcactaacaaaaaagcggcagctttggtgaaaaaggtgcttgaatctgcaattgctaacgcagagcataatgatggtgcagatattgacgatcttaaagttgcgaagatttttgttgatgaaggtccaagcatgaaacgtgttatgccacgtgctaaaggtcgtgcagatcgtattttaaaacgtacaagccacattacagtggttgtgtcagatcgataatagtagaggaataacaatgggtcaaaaagtacatccacatggtattcgcctaggtattgttaagccttggaactctacttggtttgcgaatacacaagatttcgctgataatttagacggtgatttcaaagtacgtcaattcttgaataaagaattagcgaatgcttcagtttcacgcattactattgagcgtccggcgaaaagcattcgtgtaacaattcacacagctcgtccaggtatcgtaattggtaaaaaaggcgaagatgttgaaaaattacgtaacgcagtagctgctattgcaggcgttccggctcaaatcaacattgctgaagtgaaaaaacctgaattagatgcaaaattagttgcaggtagcattgcttcacaacttgaacgtcgagtaatgttccgtcgtgctatgaaaaaagcagtacaaaacgcaatgcgtttaggtgctaaaggcatcaaagttgaagtaagtggtcgtctaggtggcgcagaaattgcacgttctgaatggtatcgcgaaggtcgtgtaccactacatacattacgtgcggacatcgattataacacctcagaagctcatactacatacggcgtaattggcgttaaagtatggatcttcaaaggtgaaattcttggtggaatggctgcaattgcacaacaaccggaacaacaaccagccacgcctaaaaaggctccacgtggtaaaggtcgtaagtaaggagatttgctaaatgttgcaaccaaaacgtacaaaatttcgtaaagtccacaaaggtcgtaaccgtggtattgctggtggtacagaagtgagcttcggtacctttggtttaaaagcagttggtcgtggtcgtttgacagcacgtcaaattgaagctgcacgccgagcgatgactcgtgcggttaaacgtcaaggtaaaatctggattcgtgtattcccagataaaccaattactgaaaaaccattagaagtccgtatgggtaaaggtaaaggtaacgttgagtactgggtagctttaatccagccgggtaaagtaatgtatgaaatggatggtgtatctgaagaagttgctcgtcatgcgtttgcattggcagctgcaaaacttccaattaagacaacattcgtaactaaaacggtgatgtaatgaaagctcaagaactacgtacaaaaactgttgaagagctgaatgctgaattggttaacttgttaggtgagcaattcaaattgcgtatgcaagcagccaccggtcagcttcaacaaacccatcagttaaaacaagtgcgtcgcagtattgcacaagtaaaaactgtattaaccgaaaaggcgggcgcataatgactgataaaattcgtacagtacagggtaaagtgattagtgacaaaatggataagtcatttgtggttgctatcgaacgtacagttaaacatcctatttatggtaagtttatccgtcgcactactaaactgcacgtacatgatgaacataacgaagcaaaattgggtgatgtagttgaagttagagggtgtcgtccactctccaaaactaaatcgcacactttagttcgtgttgttgagaaagcacaggcttaattgacaacgtatataagtaagaacctagcagaaatgctaggtttttggtttttttgatttatagaaatttttaaaattttactgctgataagcacgatatttaatataaattataattatattttaaaaatgattattgttttttagttttataagaaaatctgattctaaccttaaaattatttaaggataaaaaatgaaactatataaatttagaaaagaattatttgtattgactcttttagtctccggcagcagtatctcagcagagatcattgcggaattagatgaagttgtcgtatctgatagtagcagtgtagctgattttcaatcactcgcttttcaaggtggtcgtaaagctagtgatgtatttattgagggtaaagagtttaaaacacgttctgccaccttaggtaatgctttagccggagaattgggcgtgcattctaacccctttggaggcggagcaagtgctcctgtgattagagggcaagaaggggtgcgtattaagcttttgcaaaatgggtcggatattgtcgatatgtccaatatttcgcctgaccatgctgtagtcgctgatacacttttagcacagcaggttgaattggtgcgagggacatctaccttaatgtatggtatggcatcacctgccggtgtagtgaatattgtcgataaccgtattccgacttctcgtcctgagaaagggtatgagggagagatcgtttcacgttttgatacagcgagtaaagaaaaagtcttgaccgcaggggttaccttagcagcaggcgataatttcctgattcgtgccgaggggctgacacgcaaatcagagaattaccatgtgccagaggtatttattggtcaaaaattaaactacctaccggatagtcatcataaatcaaaagtaggaacgctaggcacaacttggataggcgataaaggctatttaggcgcctccgtaagttatcgtaaagaccgttacggtattcctgggcataatcatgcgtttgattattgttcagggcatttgtttgatacagataatttgaaagccattacagggggggatggtgaggcaccttatcttaatgcttacccacatttgatgacagatgctgatatgatttcttctctacatttccattgtggtgcggatatccaagggcataagcatagccatgaaagtatttatggacatgatcatgatattagtgaagcaggtcctgtcgtggatatgcgttctaagcgttatgatgtaagaggagagtggaaatcacctattccagggattagcaaagtaaaactctcgcttgcttatgcagactattatcacgatgaaaagcatgatggcaaggcacatattgataagaatgattcgcagggcataaaagatagaaagaaatatacggctgccattatgtcaggaaaaccagaagctttttatgctaatcgtggatttaatagccgtttagagatttatcatcaacctacagagcattttaatggtgtagtagggatgcagtatcaaacacaaaaaactaaagttcagcgtttggcacctagtttaaataataatggacaagatttaagtggtgagagaaaagagtctgaacgtaatccattggtaccgcacacgaataagcaattcagtgtatttgcattagagcaatttacttggcgtaattttattgttgaagtgggggcaagatgggagaaacaacgcattccaatcaaatatgatccgcataaattacgtcttgataaagctgcaggttctaaagttcgtctaccagatttatctccttatactgaaaatgctgtgtcatattcaggtactctaatgtgggattttcatccggcttatcgactgtctatcacgggctcgcataatgaaagaattccatcaccaatggagctgtattatcatggtaaacatcttgcaacaaattcctttcaatatggcaataaggatttaaagaaagagcggtcaaataatgtagaaatcggtctgatgcgtatttccgacaaatgggattttaaagtcagtgcttattaccaacgctttaagaattatattcacaatgagaatttgtatcgcgagggtaacttatttatgcgtcgctataaccaatctcaggcaaggttctatggttttgagggcgaaatcggttatcagataacgcctaatcataaaattacgttctttggcgattatgtcaatggtaaactctttggttttaaaaaattctatggtaatccgaagtttaaaagggtatgtgaacttgagaatgatggaaaaaataatctcgagaaatgtgttgagaacgaagaatggggggaggaatggagctatcataaaattggagagcaaactatcgaacgtcccaaccgcaatgcagcccgtgttccccctatgcgtttgggatttcgtctaaagagccagtttaacgataattggtctggctcattggaatatacgagaatgtttgtacaaaaacgcatatccattaatagcgtgatcaaagagattgatcgtgaggaagcagagaagcgaagagaaaatgcgaaagggcttgggtatgacggtcattatacagaacttgtccctgaagatgttacccaaggctatcacttactgaatctttctctcaattattcacgtaaaatagatggagtagaatatagtgcgacattaagtgcgaataatttgttgaatcaaaaaatctatattcataactcctatttgccttatgtaccgcaaatgggcagaaattttattttgaatgtcggggtaacattctagttgttcgtgaggatatcaaagagcggttgttttttgcaaaataaccgcagtatgttttctttaacgaaacctgttatctttttccaaaagttacttgataagtgcggtgctattgtgctaaactctgcgacctgtttaccatagggtagatgggttcgtcccgaaagggtgttttttattttaacggagcactaatatgatccaagaacagactatgctggatgttgctgataattcaggggctcgtagcgtaatgtgtatcaaggttctaggtggatcgcaccgtcgttacgctgctatcggtgatatcatcaaagttactgtgaaagaagcaattccacgcggtaaagttaaaaaaggtgatgtgttaaaagcagttgttgtgcgcaccaagaagggtgttcgtcgcccagatggtgcagttattcgtttcgatggtaatgcttgtgtgattttgaacaataacactgagcaaccaatcggtactcgtatttttggaccggtgactcgtgaacttcgttctgagaagtttatgaaaatcatctctttagctccagaagtactataaggagaaaatgtaatggctgcaaaaatccgtcaaaacgatgaagtaattgttcttgcaggtaaagacaagggcaaacgtggtaaggtaactaaagtgttaccaaacggtaaagtttttgttgagggtgttaatattatcactaaacacgaaaaaccagttcctgctttaggtaaagctggcgggttagtgaaaaaggaagcggcaattgatgtatcaaacgttgcaatctttaatccaacaacaaataaagctgaccgtgtaggttttagaattgaagatggtaagaaagtacgcttcttcaaatctaataatgaaattatttaaataactggagtaatgtgatggcgaaactgcatgattactacagagatacggtagtcaatgaattaaaagcaaaattcaactactcatctgtcatgcaagtcccacgaatcgaaaagattaccctgaatatgggagtgggtgaagcattgaccgacaaaaagttgctagataacgcagtagcggatttagcagcaatcagtggtcaaaaacctttagtaactaaggcacgcaaatctgttgcaggctttaaaatccgtcaagggtatccaatcggttgtaaagtaaccctacgtggtgaacgtatgtgggaattctttgaaagattgattactatcgctgttccacgtatccgtgacttccgtggtttaaacaccaagtcatttgatggtcgtggtaattacagcatgggtgttcgtgaacaaatcattttccctgaaatcgactacgataaagtagatcgtgtgcgtggtttagatattactattaccacaacagcgaaaagtgatgaagaaggtcaagcgttattagcggctttcaattttccattccgtaaataaggtaggttatcgtggcaaaacaatcaatgatcgcacgcgatgtaaaacgtgctaaattagctgataaattctacgaaaaacgtgaagaactaaagaaagtcatttctgatgtaaatacatctgatgaagaacgttgggctgcagtgttgaagttacaaacgcttccacgtgattctagtccagttcgtcagcgtaatcgttgccgtcaaactggtcgtcctcacggagttcttcgtaagtttggtttaagccgtattaaggttcgtgaagctgctatgcgtggcgaaataccaggtcttaagaaagcaagttggtaatttaccactttattttggaatcggagtaaaagcacaatgagtatgcaagatccaatcgcagatatgttgactcgtattcgtaacggtcaagctgcgaataaagttgcgattagtatgccttcatccaagctaaaagtggctattgccaatgtattagcggaagaaggttatattgctaacgttaaagtttcggaaggcgttaagcctgaattggaaattacattaaaatatttccaaggaaaaccggttgtagaaagtattcagcgcgtaagccgtcctggtcttcgtatttacaaacgtaaaaacgaattgccaaaagtgatgggcgggttgggtgttgctgttgtatctacatctaaaggtattatgactgaccgtaaagctcgtcaagcgggcttgggcggtgagataatctgttacgtagcttaagaagagaggtaggaaaatgtctcgtgttgcaaaagcacctgttagtattcctgccagcgttgaggtaaaacttgacggtcagctactaacagtaaaaggtaaaaatggtgagttatctcgcaccattcataactcagttgaagttaaacaagataataatcaattaacattctctcctcgtgtaggtattgctaatgctgatgcacaatcaggcacagcacgtgcattggtcaatgcgatggttatcggtgttaatgaaggttttactaaaaagttacagttggtgggtgttggttatagagcacaaatgaaaggcaatgtacttgtgctaagtttaggcttttcacatcctattgaccatgtgttaccagctggtgtaactgctgaatgtccatcacaaacagaaattgttctgaagagtgctgacaagcaattgattggtcaggttgcagctgatattcgcgcttatcgccgtcctgagccttacaaaggtaaaggggtacgttatgctgatgaagttgtacgtatgaaagaggccaagaagaaataattaaggtaacactatggataagaaatcagctcgtatccgtcgtgcagctcgtgcacgtcatatgatgagagagcaaggtgtaattcgtttagttattcaccgcacttcgcgtcatatttatgcacaagttattgcaccaaacggttcagaagtgcttgctactgcctctacagttgagaaagcaattagtgagcaagttaaatatactggaaataaagatgcagcggcagtggttggtaaaattgttgctgagcgtgcattagaaaaaggtatcaaaagtgttgcttttgatcgttccggttttaagtatcatggtcgtgtccagtctttagcggatgctgcccgtgaagctggtctacagttctaatagaggtaattttagatggcaagcatcgaaaaacaaactggtgaactgcaagagaagctaatcgcggtaaaccgtgtatcaaaaactgtaaaaggtggtcgtattatgagctttactgctttgacagtagtaggtgatggtaacggtcgagtaggttttggttatggtaaagcgcgcgaagttccggcagctatccaaaaagcgatggaaaaagcacgtcgcaatatgattactgtggctttaaatgaaggcacattacagcatccaattaaaggttctcacactggttctcgcgtatttatgcaaccagcaagtgaaggtacgggtatcatcgctggtggtgctatgcgtgctgtattggaggttgcgggtgttcgtaacgttctttctaaagcatatggttcaaccaacccaattaacgttgttcgtgcaactattgatgcattagcaaatatgaaatcaccagaaatggttgctgccaaacgtggcaaaaccgttgatgaaatcttggggtaattgatgatggcaaaaactattaaagtaacacaagttcgtagttctattgctcgtttaccaaaacacaaagctactttacgtgggctaggtcttcgccgtattaatcatactattgagttaattgatactccggctatacgtggtatgattaaccaagtttcatatatggtcaaagtggaggagtaagagaatgcgtttaaatactctatctccggctgaaggtgctaagcacaatgcgaaacgcctaggtcgtggtattggttctggtttaggtaaaacaagtggtcgtggtcataagggtcagaaagctcgtactggtggcggtgttcgtcgtgggtttgagggtggtcaaatgcctttgtatcgtcgattaccgaaatttggttttacttcaatgaaatcagctgtaacagcagaagtccgtttgaatgacttagccaaagtagaaggtaatattattactttagatacattaaaagcagcgaatgttttaacaaaggatatccggtttgcgaaagtaatccttgctggtgaagttaaaactgcggtaaccattcgtggtttaggtgtaactaaaggtgcaaaagtagctattgaagctgctggcggttcaattgaggaataattaacaaatggctaagcaaccaggttatcaaaatagaagtactcaaagcggtactagtgaactaaaaagcagattattatttgtgctaggtgcactgattgttttccgtattggttccttcattccggttcctggtattgatgcggccgtgctggctcaattacttgaacaacaaaaaggcactatcattgatatgttcaatatgttctctggtggtgcgttgagtcgtgcgtcaatttttgcattaggtatcatgccttatatttcagcatcgattattattcaattattgaccacggttcatcctgctttagcagagttgaagaaagagggagaagcgggaagacgtaaaattagtaagtatacacgttattctactctcgtattagcaactattcaggcaatcggtatttctactggtctacctaatatgctacctgggttagttcctaatttaggctttggtttctattttacagcggtaattagtcttgtaacaggaaccatgtttctaatgtggttaggtgaacaaattacggagcgtggaataggtaatggcatttcttcaattatttttgcaggtattgttgcagggttgccttcagcaattggtcaaactattgagcaagctcgtcaagggcaaatgcatctattagttcttttattgatcgcagtaattgtttttgcggtgacttattttgttgttttctttgaaagaggacaaagaagaattaaagtcgagtatgcaaaacgtcaacaaggtcgtcagatagtaggtggtcattcaactcatctaccattaaaagtaaatatggcaggagttattccggcaatttttgcttcaagtattattctttttcctgccacgttaacatcttggtttggacaaggttctaatttggaatggttaactgaattatcgctattattacatccaggacagcctttatatctgattgtttatgctgtggctattatattttttagtttcttttataccgcaatgcaatataatccgcgtgatacagcagataatttgaaaaagtctggcgcatttatacccggaattagaccaggtgaacaaacatcgcgttatattgataaaattatgactcgccttacattaattggcggattatatattacgtttgtatgtttagttccttatattatgacatcagcttggaatgttcagttttattttggtggaacgtctttgttgattgttgtagttgtaattatggatttcatcgtacagattcaaagtcatttaatgtcaaccaaatatgaatctgcgttgaaaaaagcaaaccttaaaggttttggacaataaatgtccatatagtaaaaaggataagtaatgaaagttcgtgcttcagtcaagaaaatgtgtcgtaactgtaaaattgttaaacgtgaaggtgttgttcgtgtattatgtagcgaccctaagcataaacagcgtcaaggttaattgatatttttcttgcaaagaaccagctgggtatatataatactcagctcatttatgtccttgatatgctgtttgagtatcctgaaacgggcttttcaagatcagtatatcaaatttaatcaataaaataataggagtgcatagtggcccgtattgcaggcattaacattcctgatcaaaaacatactgtaatcgctttaactgcaatttacggtatcggtaagactcgagctaaggcaatttgtgcagctgcgggtattgctgaagatgtaaagatcagagaattgtctgaagagcagattgataaactgcgtgacgaagttggtaaatttaccgttgaaggtgacttacgtcgtgaagtaacacttaacattaaacgcctattagatttaggttgctatcgtggtttacgtcatcgtcgtggtttaccagtacgtggtcaacgtactaaaactaatgcgcgtacccgtaagggtccacgtaagccgatcaaaaaatagtcggggtaaggttaaatggctaaaacaccagttcgtacacgtaaacgtgtaaaaaaacaagttgtagatggcgttgctcatattcacgcatctttcaataatacaatcgttacaattactgaccgtcaagggaatgctctagcatgggcaactgcaggtggttcaggtttccgtggttctcgtaaatctaccccgtttgctgcacaagttgcggcagaacgttgtgccgaagttgtaaaagaattcggtttaaagaacttggaagttatggttaaggggccgggtcctggtcgtgaatcaacaatccgtgctttaaatgcagcgggatttcgtatcacgaatattacagatgtgactccgattccacataacggttgtcgtccaccgaagaaacgtcgtgtttaatgacgtcataggatagttggagaaagaaaatggcaagatatttgggtcctaagctcaagctaagccgccgtgaaggcactgacttattccttaagtctggtgtgcgtgctattgatacaaaatgtaaaattgatacagcacctggtcagcatggtgctcgtaaaccgcgtttgtcagattatggtagtcaattacgtgaaaagcaaaaagttcgccgtatttacggtattttagaacgtcaattccgtaactattataaagaagcaaaccgcttaaaaggtaatactggggagaatttactggtattattggaaggacgattggataacgttgtttatcgcatgggctttgctgcaactcgtgctgaggctcgtcaattagtgagtcataaagcgattgttgtaaatggtcgtgtagttaatatcccatctttccaagtttcagttaatgatgttgttgctgttcgtgaaaaatctaaaaagcaagcacgtattaaagcatcattagaattagcagagcagagagaaaaaccaacttggttggaagtcgaagcagctaaaatggaaggtgtgttcaaacgtgttcctgagcgttctgatttatcagcagacattaacgaacatctgatcgtagagctttactctaaataatagttaaggctttgtagcaaagagaggataaaatgcagggttctgttacagaatttttaaagccacgtttagttgatattgagcaaattagttctactcatgctaaagtgatcttagaaccgttagagcgtggctttggtcatactctaggtaatgcattgcgtcgaattcttctatcttctatgcctggttatgcagttaccgaggtggaaatagatggcgtattgcatgaatatagtagtaaggaaggtgttcaggaggatattattgaggtacttctgaacttaaaaggtctagcggttaaagtacagaataaggataatgtttttctgacactaagcaaatctggaattggccctgttgttgcagctgacattactcatgatggtgatgttgaaatcgtaaatcctgatcatgttatctgtcacttaacagacgaaaatgcgtctattaatatgcgtattcgtgtacaacgtggtagagggtatgtgccggcatcatctagagttcattctttagatgaagaacgtccgattggtcgtttgttagttgatgcttgttatagtccagttgatcgtattgcttataatgtacaagcagcacgtgttgaacaacgaactgacttagataagttggttattgaactggaaacaaatggcacaatcgagccagaggaagcgatccgtcgtgctgcaacgattttagcagagcaactagatgcctttgttgatttgcgagatgttcgtcaaccagaagttaaggaagaaaaaccggagtttgatccgattttattgcgtcctgttgatgacttagagttgacagttcgttctgctaactgtttgaaagcagaaacaattcattatatcggtgatttggtacagcgtactgaagttgagttactgaaaacacctaatttaggtaaaaaatctcttacagagattaaagatgtgcttgtttcacgcggtctatcacttggtatgcgcctcgaaaattggccaccagcaagtattgctgaagactagtttggtcataggttaaagatttttctgagaaggataaggtcatgcgtcatcgtaagagtggacgtcaactaaatcgtaatagtagccatcgtcaggcactattccgtaatttagctagtgcattggttagtcacgaaattatcaaaactaccttgcctaaagcaaaagaattacgtcgtgtagttgaaccgttaattacattagcgaaagtagatagtgttgcaaaccgccgtttagcttttgctcgtacacgcaacatcgagacagttgcgaaattatttaatgaattaggtccacgttttgcacaacgtgcgggtggttatactcgtattttgaaatgtggtttccgtgctggtgataatgctccaatggcgtacattgagttagttgatcgtccagccttagctgaagaagctaaaacagagtaatttataactcatttaaaaagcccacagtaaaatgtgggctttttgtagtaatcatatttattttctattctattccctatcatcaattcctatcaataaaaaatttccgtttatattacataaacttctgaatccaacattggtaattttaaaaggatttttatttggacgttttgtgtagtcaaagctctcatggtgatgaccgtgaaaaatatgctttacttgcattgatgtggctaaattattaataacagaaaatcctaaaggatgaggttttggtgcctcatgacatattagtatatctgctttttgtttttctaatgcttcaatatcagaaggaaagattgaagttctatgacgcaatggaatacctcctcgccaaattttttccggaggagcgtattggcaataatggatatgatcaaaaaagagcggtttatttggtggcatccaaatttgtccacgaaacacgcctcctaatccggcaatttttattccttgaatgtcgacaactttaccgtgtaaattacgtgatttccattttgtaccccataaggcctcatatgctgaaactgttttgctatcatgatttccatggataaaccaaagatcacaaaactgtgccagtttatccagttcatcagaagtagttaattgtaaatcacctaaaataataagagatacatttgcatgttcttgaataaaagggtaaagatgggaataacttccatgtggatcaccagcaaataaaatcataatattattccttaaaaattgaaggtgtgattgtttccacggttaagtccaaaagttcttcgttgagtactttctcaacaatatttttcacttgattataacgttccaagtaactgggtgagtcaatttcaatataagctacactatgcttatctaataatttttttaagagttgttggaagcgttgacgttgtttagcatttcctaagctacgcaagccatcatctacccattgggtattattatttaataaaatggtcacatcaaagggatattctttgatcatggagtctaagaaagggtgtgcttttccttcatactgaatacaaaatgcctgagttgtaataaagtctgtatctacaattgcaactttgtgtgcatgcctgacggcataatcaatataacgctgatgacctaatgctatttgtggataatcagaatattgcatagcttgttcattaccccccagtttttcaaaaacaaactcacgtccatattcccaagctgatgtagtattaaatactgtagctagcttattgacaagagttgttttaccgctactttctccacctaaaatagcaattgtttttgcaaaaaatgggcgaacttctttaggaatgaatttccaatagtgaaatggattgttacgaatttttgttgcagaaatattaaggaatcggcgttttggatcaactaattcgacttgtaaatttaaatatttttcataaggtactttatcttggatttcactgctaaaaaccacgctaggattaacgtttttttccttaaatagatattttacctgttcagcccatgccgcccagccattgggataacttggtataccatcttcaataagatgatgaataacaatttgatttttctgatatttaaaaatttgttgcatccaacgtaagcgatcttgcacagttggcattcgtttcattttactgtcatagaatagttttaaatctcgctcagtatcactacatacaacgacatgaagttcatctactttgctaaatgcttcgtaaatcatattaatgtggccggtatgaacgggataaaatttaccaaaaataacgcctacttttttgttatcttgttcagtgatctgtaacactttatgcaatgctgaaagttttgtcgcacttggatttttaatttttccacttactaattgattaaaataagcacgagtaatattggcttgcgtacaaagatcattaactttcaaatttaattgcttacgtttttgttgcagatagctgaaactcgacattattttttccttttatatttagagaatatttaataggtaacatagaaagtgcggtaataaaccggtgagttttttatttttcttgtaattgttctaaacgtttctccaattcaaccagtttttcacgagttctcattaaaacttgtgtttgcacatcaaattcttctcgtgtcactatgtctaatttagataattgagattgtaagatttgttttagtttcatttcagcatcttgacccaactcttttacaccttgcgggagagcatcttgaatttgttgtataatttgttctatttttttaggattcagcataataagctccattttgatataaattgccccattgtatgcaatcttattcaaaataaaaacattttttcttattaaacgttaagatatactatgcacgcattctcagggcagggtgaaattccttaccggtggtaaatatttcgatataagcccacgagcgtttacttattttagtaaggtcagcagatttggtgaaaatccaaagccgacagtgatagtctggatgaaagagaatagagcgaggtattatacttatcgttgttgtttttctatttatctgatagaaaaaatccttttatcatcagccctgattctggtatctattaatttatttaaaggagtttactatgaatcagtcattattatctcagtttggtacatctgaagaacgagttaaacgtgcgattgaagctttcaaaagagggaacggagttcttgtccttgatgacgaagatcgggaaaatgagggtgatcttatttttccggctgaaacaatcacagttgaacagatggcaaaattaattcgttatgggagcggaattgtttgcttatgtatcactgatgaactttgccaacagctcgatttgccaccgatggtacaaaataacacaagtattaatcaaacagcgtttactgtgagtattgaagcggcacaaggtgtatctaccggcgtatcggcacaagatcgtgtaacgactattcaagccgccattgctgataatgctaaaccgcaagaccttagccgtccgggacatgtatttccattaagggctaaaaagggcggtgtgttagcacggcggggacatactgaagccgcagttgatctagcttcttgggcaggtcataagcctgctggggtaatttgtgaaataaccaatgatgatgggagcatggcaagaacactggagatcgtagaatttggcaaaaaatttaattacccagtggtaacaattgaggatcttgtccgttatgcctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaaaataaaatgaagactatgcaagatgaaaaatctgttaaactgtgtgctatttaaaatgggttaaaggataaaattattagtaacttaaaacgtgggtttgtcttacatcgacgggattatagtgaaaccagtttgttggtcgagttattcactgaagaacacggacgtttaacagtattggcgaaaggggctcgtgcgaaacgatcggcgtggaaatctttgctacaaccctttacacctttgttacttaattggtctggtcgtggggaattaaaaatattaataaaagcagaggcgatatcattaactttaccgctacaaaccaccgcactttatagtggattttatgttaatgaattaattgctcgtctattggctccggaaaccgcatatccggatctttttcaatattatttgcaatgcttaactgcattggcaagctcaccgcaagaaatcgaaaaaagtttacgcacttttgaatttcaactgttggaggttttgggttatgccgtggatttttgtcattgtgctggttcggggaaaccagttgatgaaaagatgacttatcgctatcgagaagaaaaaggctttattgcttctttaattaaggataacctgactttttatggacgtgaattattagcttttgagcgtagagaattcgtcgataagaccgtcttgcaggcggcgaaacgttttagccgtattgctttaaaatattatttgggtaataaacctttaaaaagtcgtgaattatttacgcagaatattttacatacaaaataagttttactagatataaatttatggttttactttatcagccaaagaaacaaaaaaaattgagagcagcttttacgaccattgttcaagatttggattatcaaggattaggtgtagcaaaaattcaaggaaaaacgtggtttattgagaacgcattaccacaagagcaagtacaggttcaagttattgaagaaaaacgtcaatatggactgggtcgagttcaaaagattttacaagccagccctttgcgacaaactccaagatgtgcttattatcaaatttgtggcggctgtcaatctcagcatatccctatacatttacaacgtgaaacgaaacaaaaagcgttatttcagcgtttaaccaaactgcaaaaagaggctatagactttatgccgatgataagtggcgaagcatggcattatcgccgtagagtacgcttaagtttgtactgggacgctaaaagtaaaaaattgaagataggctttcggcaaaaaaattcacaacaaatcgtgaatattcgtcaatgcgatgtgcttgatcccttgttaaatgagttattacctaaattgcatgagttgttgagtacgtggtctaaaccgaaaacactaggacatattgaattagttgccgcagataatggcgtagcgatgttattgagagtaacagaaaaattggctgaacatgaccgcactttattgttggattttgcatttaatcatcaagtgatgttatttgtacaagatgaaaaagagatttgtcatttgcaaggagatttgccttattaccaattagatgatggttctattttacattttgatattcgtgattttattcaggttaatcgccaacttaaccaaaacatggtcaatactgcactggattggttggatttgaagaagaaggataatgtgttggatttattttgtggtatgggaaattttaccttgccgattagccgatatgtgaaaagtgcggtaggaattgagggtgttttacctatggtcgaaaaagcccgtcgtaatggggaacgaaatcattgtcataatgtccaattctaccagtgcgatttaagtcaatcttttactgagcaagaatgggcaaaggttccttttgacaaaatcttactggatccgccgagaagcggtgccgcatttgctttaaatgcattgtgttatttaatggctgaaaaaatattgtatgtgtcttgtaatccggcgacattagtgcgtgatgtggagcttttgcttaagtttggttatcaattaaaaaaagtcgcaatgattgatatgttcccacatacaagtcatctggaaagtattagcttatttgaaaggaacagataggaagtaaagttatggttgcagtgcgtggttcacatttacttaatttgcaagattttgtggttgagcaatggagtaaaagtttatctttacctgagaatgttgaacaaaaattaatacaggcttggcgttatgcacagcaaaagtgtcttattgtacaaagtgaatcggagaaaaaaattgtttgttctttgcaagctggtgtggaaatggtggaaattctgcatagtttgaatatggatgcggaaagtttgattactgcaatgctttatccattggtgaaccataaaatgacttcccttatgcaaatcaaagaagattttggcagtaatattagcaagttagtgaaaggcgtagtggaaatggataacattcgccaacttaatgccagtcattcagccaacagtttgcaggtggataatgttcgtcgtatgttattagctatggtggatgattttcgttgtgtcatcattaaacttgcggaacgtattagctatttacgggatgtagaccgcttgtattctgaagaagaaaaagtactggctgcaaaagaatgttctaatatttatgcaccgcttgcgaaccgtttgggtattggtcaattgaaatgggaattagaggattattgtttccgcactttacaccccgatacttaccatgcgattgcaaacttattaaaagaacgtcgtttggaccgtgaacaatatatcgcggattttgtgcaggagttacgtggttatctgaatgagaatttggatcaagtagaagtgtatggacgaccaaaacatatttacagtatttggcgtaaaatgcagaaaaaacacttggaatttagtgatttatatgatgtaagagcggtcagaattattgtacaaaaattgcaagactgttattccgctttgggcattgtacatactcatttcaaacatttgcctaaagagtttgatgattatgttgctaacccgaaaccgaacggttatcaatctattcatactgtcgtgttgggcaaaggtggaaagcctattgaagtgcaaattcgtactcaacaaatgcatgatgatgcagaattaggtgttgctgcacattggaaatataaagagggtgtaagtggcggacgttccggttatgaagaaaaaattgcatggttacgcaaattattagcttggcaagatgatattacagattctggcgaagtaatggcggaaatgcgtagtcaagtttttgatgatcgtgtttatgtcttcacgccaaaaggcgaagttgtggatttaccaacaggatctacccccttggattttgcgtatgctattcatagtgaaattgggcatcgttgtattggtgcgaaagttggtgggcgtattgtaccttttacttatcagcttcaaatgggtgatcaaattgagattattactcagaaaaccccgaatccaagccgtgattgggtaaatccgaacttaggttttacgcacacggcgaaagcacgtgctaaaattcagaactggtttaaaaaacaagatcgcgataaaaatattcctgccggaaaagaattgcttgaagttgaaattgcccgtttaggtatttccttaaagcaggtagagcaacacggattgcctcgctataacctgaagaatttagaagacttgtatgccggtattggtggtggagatattcgtctaaatcaacttattaactttttacaaaataaattaattaaggtgagtgcacaacaaacagatgaagaaattttgcgttatgtagccaataaaggtgctcattatgtgagtcaaaaacaaaaaacagagaaaaaaggttacgtgattgttgagggggtaggtaacttaatgtaccatattgcccgttgctgccaacctattccaggtgatgatattatgggctatatcacaatgggaagagggatttctattcaccgtggcgattgtgaacagtttatagagttgcaaaatacacaccctgaacgtgttgttgagtcagtttggggcgaaaattatgccacaggtttccgtatcagtattcgtattatcgccagtgatcgaaacggtttattgcgagatattacaacagtattagctaatgaaaaaattagtgttttgggtgtatcaagtcgtgcagatacgaaaaaacaacttgcgactattaatatggaaattgaattaaataatgtacaaattttaagtaaaattctggcaagattagcgaaattagatgacataattgaggcaaaacgtctttagataagttaggcaaagataaaggtaaagataatgaaaaaaacaaccggattggagcattttataaaatcaatagtctattccttaaaagggttgaaaagcacgattcaacatgaaagtgcttttcgtcatgagcttgtggtttgttgtattttatttcctttagcgtttcattttgcacaaagcaaaattgagtttgtgcttatgattggttctttattattggtgctggttaccgaattgttgaatagtgcaattgaagttgtggttgatcgtattggaacggaatatcatgagttatccggacgagccaaagaccaaggctcagcagcagtttttgtcgccataatccttgcactatttacttggggagtgattttattttgttagcgtgttgacatccgccctgccttcaggtggggcggatgtcaatagactagaaacgaacttccacggaagcggcaaaattgcgttttggtgcggtaaaacgattgataccttcccctttaagtcctacagaacgagaagtaaagcctctggtaaaccataagttataggcactgtcccaagttgtataattacggttgaataagttaaaaatccccatatttaatgtaacatttttactcaggttaacttgtcccgttaaatccactacaaagtaagaaggacttaagaaaggccattgtttgacatttttagcaacatcaccacttttgttaccgccaagttcatattctgtttctatagcatctttggcttttttagccgcactgtaacgaccggttaaactgatactccatttttccgtttcataatcaattcccccaaccactgtccaaggctgaatggatttaagcggatcgccatcatgattttgccctttgctataactccccttaaggcggaatgttaatccatccgacagtcccaatgccgagccgttaacagcaccgctaacttctatccctttaattaccgctttaggctcattgacaaattgagctaacgaaataaactgtttcgaaccaccccaaaaactactaggattgtagtatggatttggcttacatctttcacgctcttggataaagttatgataacgtgtgcggaaaagcccgacgctaaaatgggcatattggttttggaaacggtaggttaattcgtggttcagtgcagtttccggttgtagaaacggatttggaatatactcattagctgtaccactaccgtcacttacaaaatataaatcttcagcacgaggcactcgaaaaccggtgcttaggcggtagccaatttgatgtgatgggtgtacttgatattccaaccccaattgccaagacagatgggatagttttcttgaggggaagttgattttggcattattgacttgccccttgagttgaggggcgtaattataacgatcataacgtccgccaatagtggctttcaatgtatcggttaaagcgacttcatcaagcaacgatagggaaaaaatacgagattttaccggaacaacttccgtataatttgggcgattttttttcattaaatacgaactagtagagaaacgttgagaattactgttttccaaaaattgatcacgaaattccactttgccggataagcgatgcgtggttcgccataatgctaatggataagttgataattctccacgagtaatagtttgatcttgaatgtactgataggaagcaagttgaaataattgattattcctaataccacgaagagctgaaagttgctcaattttctgttttgccacaaagagttttgctgtttctaaccaagataagccattatatcgatattcgagaccataacggcggtatggtgttctgtctgtggcaaatcggttctcatcgctaatccccaatgttttttcttcggtaaatttcttttctgcacgatcttctaaaaatagtgtaaagcgatgggtgttattaatatcgtagccgatttttgttaaccatgaggtggtgtggtagctgagggggttgggtttgccacgacccggaccggtaatatccgcacctttgccgttattgattgtttcatgtccccaacgtttggttaattgtgcaaaaccgaagaagcgatcagtcttgaaccccccccctatcacttgacgccattctctattttttgaggtataaccggttttggataagaagccgaaagtgcggtcaggttcgacaaaatcttcaatctctttggtggtaaaagaaaccgcacctcctaaagcaccactaccatttattacagaatttgcccctttctgtacttttaccgagctaatattttcatattccgtattattgatattgccattgtgacgttcggtagaataacgtgcggaagtggacattgttgattcggcttgcggtataccatcaacaatcaccgcaacgcgatctttgtcgacaccacgtattgcaaagccgttactaccggaacgaccgccttcaggcacgccaatccccacttcatgacgaaataaatcacgttcattagacaccatatttttccgcaattgttcggaagattgagtagaggaaaaaataggcttaacattcgccacaacggatatttcacccaattcttccgctttatttggctttgttttttcttgattcgaatcggcaagacttaatgcaggaaacatcaagctacttgaaagaaataattggttgagaataatagaatacttagatttcaaaatgaaaatctccctgtaaaaaatataatagaaatgagaatggttcttataattataaatgccctaactgtcaagttttttaatcatttttatggaaagagtaagttatttgaataaactatattgttgctaaacaaaacgttgcttgtgaaatgtatttttcactagcatttttaccaagagtttttgtattatatgagcaaaataagtatgccttgattcatatagatataaaagagttgttaaatattaatgcgataggatatgttaaaaaaattcattttacttgttatcccgatgttgctaacggcttgtgcatcttcgttaaaagtgcttgaactgccacaagtaaaaacagacagcagactttttgtgattacacaacaatttcctcaatcggaaaaaagtttgctggcgattgaagttcaacctcatcaatggcgttgggtgcaaacagatccgctcggtgcacctattgctcgtcttgttttgagtaaagcggggtggcaaaacgacggtttcgttatgccgaataagcaggcaaaacagcttttttctgcgattgcgacgtattttatgtcgactatgattttcgatgtccagcagatctcggaaaatgaatatgcacaaaaccatcggttaatatggcgattttctccgcaaaaacacggcgttaatattgagttgggggataagtctgtttggtttgtcgaacctttgagactgaattaaaattgtactaattatcagaaaataaaatgacggaaaccttatatttatcaaaacctgcgataatcagtgctatgggcgaagggctgaaaacgcatatagaaatgttattgaatgcggagcattccccgttagtgcattccgataaggtgtttagtcggcatcacattgccggtaaaatcggtgtcttcggcgagataaatttatcattacgcccatttccggaaaagcttagtgtacaacaccgtagtcgtaataatcaggtattgtggcacgcattggcagatattgaaccgcaaattgagcaagctgttcagcagtttggcaagcaacgtatcgctgtggttattggtagttcaacaacgggggtagatgaaaatatccctgttttcaaaggtggagcaagccaacaagattggtcgttagcaccttttaattttcagcaagtttcattttccgctccagcagattttgtggcggaagtttatggtttaagcggtttagtctatggtatttctactgcctgtacttcgggtgcaagagcgttaatcagtgcggctcggttattgaaaaataatttgtgtgatgcggtaatttgcggtggtgtagatacgctttcaccgctaacggtgagcgggttcaattctttatccgtgctttctgcacagcgtacaaatccgttttctcgttatcgcaacgggataaatattggtgaaggtgcggcggtctttttaatgacgaaaacaaagttaaatgatgaaagcctacaattgttcggctatgggtcgagtagtgatgcttatcatatgtcttccccgcatcctgaaggcgagggagcaatttccgcttttgagaatgctttaaaaaacgccaatgttaaggctgaacaggttggttggattaatttgcatggtactggcacggttcaaaatgatcacatggaaagccttgcggttgaaaagatcttcggagataagaccacttgtaccacaactaaggtatatactggacatacgctgggtgcggcaggtgctattgaagcggcgattttgtggggtatgatcagtcgagattataatccaacgggtaaacttcccgcacaattgtgggatcaagaaaaagatgaaaatctgcccgcacttgcgattacagatcgggatagttattggaaaatggatagacgtattggtgtaagcagttcttttgcctttggcgggaataattcggttttggtgttgggggagtagcatggttaatttgcattgtccgattacgcaagtggctcccttgctgccgcatagtaacgatatggtgttgcttgatcttattacggattttggagaagattttttgatcgccgaggcaaggattaaaagcgataatattcttattcgagaaggtaaactcagcgcattttccggtattgaaattatggctcaaggtgtggcggcttgggcgggatgtatggctgttcaagccaatgagccggtacgtttagggtatttactcggcacgcgtaaattacatatttaccaagatgagattgcgatcggtagccgtcttcagattaaaataaacatgtccattcaagatgcgacggggtttggtgtatttgattgtcagcttattgatttagccgataatcatgtgattttggaaggggcattgaatgtgtttagtcctaaggaggaacaacaataatggcaaagacagttctgattaccggctcaagtcgcggtatcggcaaagcgattgctttaaaccttgccgcacaggggtatgatattgtggtgcattgtcgttctcgtgtagatgaggcggagaaagtggcacaagaggtgagagctttagggcaaaatgcaagggtactccaatttgatgtggctgatcgtgaaaaagtgcggtcaattttagaggcggatgtagaagaaaatggtgcgtattacggcatagtacttaatgcagggctaacccgtgataatgcttttccggcattgaccgatgatgattgggatagcgtgttacgcaccaatttagatggtttctataatgtgttacacccgattatgatgccgatgatccgtcgtcgtcaagcggggcgaattgtgtgtattacgtctgtttcaggcttgattggtaaccgtggacaggtgaattacagtgcgtctaaagcgggacttatcggtgcggtcaaggcgttggctatcgaactggcaaaacgcaaaatcacggtaaattgtgtggctccggggttaattgatacggatattttggacgaaaatgtcccgatagatgagattttaaaaatgatccctgccggacgcatgggcgatcctgaagaagtcgctcatgccgtgcaatttttaatggatgaaaaagccgcttatattactcgccaagtgattgcagtgaatggcgggctttgttaaagagcggtaaggatttcaatatttttattcacaattgaacattaacagcaaaaaggatacgaagtgaaacgggtggtagtcacaggaattggcggtatcactgcttttgggaatgattggcagaagataaaaacagcttttcaacgtaaacaaaatgccgtcaaatctatgaatgattgggttgaacgttttcccgaattggatgctcgtttaggtgcggttattgaggattactatcctccgaaacattggaaccgtaagcaattacgcagtttagggcgtgtttctcagctcgtagttgatgccagtgagcgagccttggctaacgcttctttattggacgaagacggtattattttggaatatttgaaagacggtagaatgggtgtggcttgcggttcttctaccggttctactaatgatattaaagatgcggcagaacttttgatgaccggtaagtcagacggtttcaacgccaacacttatgtacgtatgatgccccatactacggcggcaaatattggtattttctttggtttaacaggtaggattatccctacttccagtgcttgctcatcaggcagtcaagcgatcggctattcctatgaagccattaaatacggattgattcctatgatgcttgctggcggtggtgaagaattttgtccgtcagaggtttatgtttttgacagcctttatgcggcaagtcgtaataatgacaatccaagccatacgccacgtccatacgataaagcacgtgacggattggtgattggcgagggcggttgtatgtttgtgttggaagagcttgagcatgcattagctcgtggagcgaatattattgctgaagtggtcggttatggtgcaaatagtgacggtagtcatgttacccgcccgcaaaaagatacgatgcagcgttgtatggaattagccctgaaagatgcagggattgaaccgagtaaaattggttatgtcagtgggcatggtaccgctaccgaacaaggcgatattgcggaaacgctggcgacagaagccgtatttgggtatgttcccatgagttctcaaaaaagttatcttggtcatacgttgggagcttgtggtgcattagaagcctggtttagcattgaaatgatgcgagatggctggtttgcaccaacgattaatcttgacaatgtagatgagcgttgtggtaaggtggattatattcaacatgatggacgagaaattcacacggattatgtcatgaacaataatttcgcattcggtggggtgaatacttctcttatttttaaacgctggacggatgaatagtggtaataagtcgctacatttcggggtgtacattatagaaattgctatggaattagctaaaattagcggcgttttgtaaagttgtggatagagaaaaagcgtatggcaaagatgataaatgatgggtgtaatatcgataatgactttgttcaaaagagtattaaacaatgacgcaacaaatctgtaatttttcatttaatcttcatgcgtggaatattgtctgtaataaagagctttccggagaggattggcaacaaggcgagcagtattggatggaaagtgttgctaaacgtgaaactgttgcacctaaactggcttttttaccgccgttaaaacgtcggcgtttaagtgaaagtgcacgtttattttttgaggcggcatggccattaaccgaacaagagaataatttgccggtggtgtatgcttcgctgaatggagaaatcaatcgtagctttgccttgtggcattctctcttaactgaaggagatgtgtctcctacttcatttagtctttcggtgcataatgcccttgttggacaatggtctgaaatgcgtcaggttaaaaatgaaacgacggctattaccgccttaaaagatagcttggaaattgccttattagaggcttttctactcttaaatgatggacaagaaaaggtgctggtcgtgctttcggaaacaccgttatcagtgaaatacaatgctcaacccgtggagcgtttgcctttgtcttatgcgttggcgatggtggtggaaaaaggctcgacttatcagcttagtttgcaatcgcaagctgttgaaagtgcggtattttttgataatgcacttgcttgggtacaacagcaatatttgggggcatcccaatggcaaacccaaagtagtcgtggaggaacttggttatggaagaaaaacttgattggctaaggcgttttctcggtacgttatttggttttatattgttcggtttcgtcggcgtgctgtttaaaattatcctttatccttatgcaaagcaatatctcaaggcagatttagctacgcaattaaaaggacgtaaaattgtcagtcgtacttgggcattttttgtgcgttatcttatttgggcgggtattttagaggttcgttaccatggttttgagcgattggggcgtaaaggacagttagttttagctaatcacccctctttgcttgatgtggtgctgatttttagtcaagtgccggagtttaactgcattgtgaaacaagatttgttaaaaaatcctgctatgagcagcccgataaaagcctgtggttttgtgccgaatacagaatcggaagaattattggaaatgagccatcggattttacaagaacaatccttattactttttccggaagggactcgtacaggttgggatggtgtggtgaaattacatcgcggtgcggtttctattgggttgcgtagtgcaaaagtgatcacgccggtggtgattaaaatgaccccgttaaattttaaaaaaggacaaccttggtataaaattcctaaaactaagattacgtatgaactaacagtgggcgaagatatcgatccgcaaaagtggttggcggaaaagcccttgcctattgcctctcgccgtttaaatcaatacttggaagattattttaactcacaaacaaaggactaaataatggaacttgaattacaacttaaacaattaattattgacagccttgcacttgaggatattggtgttgaggatattgacactgatgcaccattatttggtgatgaggggttgggactggattcggtggatgcgttagagctgggattggcagtccaaaaaacgtttggtttacaattggatagcgaacaacaaaacttgcgtaatcattttgaaagtgtggcgactttagcaagttttattcaaagtcagaaacagtagaggaaaggaagtgaaatgacagaacaggaaattcaaaaggtgttgacggaagccttagtttcattatttgaaattgatgcggacaaaattaagcctgaaacaaatttataccaagatttagaaattgacagcattgatgcgattgatttaattgactatatcaaacgccaaaccggttataaattaaaggcggaagatttccgcaatgtgcgtaccgtaagtgatgttattgctgcggttcaaaaaatcagcgaaaacgcatagtcaagttgttgaggttgataaaacagcctttggggtcaagaccttgaggggggggatagtttggtgagtatagagcagcgatgcatgcaaagtgagcctgtgcagaatcctatttggttaagtgaaatacaagaggaaaatgtccaaattttccgagcgaaagtgccgccggatctgtgctatttcaaagggcattttgctaattttcctcttgtgccgggtgtggttgagttgcaatgggtgaaagagaaaatagatgcttactttggcaaagaaatgcagatgaatcgcattgataatttgaaattccaaaaatttcttcgcccaaacgatgaatttgagctcacattaaaatgggaagaaaacaaaaatcgaataggttttcagctcaaaactgagggcgaaatgtgtgccagtggtttcgtgatttttaaaaatggttaaattattcaatttattgattaacttggggttactgcttaccggcattggttatccgctggcgtggttttttgatgaaaaacaccaagggctttcttatttagtagcaataatggcgttattatgggcaatcaaagcgataaaagcggtcagttttcatcggtttttggcaatcctaatggcgatattgcttggcgtcgtttggcttactcgtagtctggaaacaatgtattggtatcctgtcatcatcagtacggcaatgcttattttatttggtggtagcttatttagctcacaatcgcttattgagcgtttcgctcgcctacaagattccaacctttctcctcaagccgttagttacacccgaaaagttaccctagtctggagtggattttttgtgctaaatattaccatttgcaccgtacttatcctcgctggacaatatcactggtgggcatggtacacaggcggagtttcctatgtactaatggggttattgatgtgcatcgagcggttggttcgacaagaggtaatcaaaaatggataagcaacataatcaagggtatgcggattttgctttgcgttgtcagcaaatacgccaacagcttgaggaagatcaggtaaaatcggtagggttatggttagataatgcagatcaatttgcctgcgtgttattggcttgtttgaatgcaaaagtcaatgtgttgttaccgccgaatttactcaatgaaaaccttgaatggttggaacaacattcagcattactctttgataaaaaaatggttgagcaatttgggcgtttgcaaaaaactcaaaaaatccaacctcttttggataagcagaatgaaagtgaaatttggttgaaaacatcaggcagcagcgggcaggcgaagatcattaaaaaaacggcaaagcagatgtggcgggaatctcaagccttagtttctgtcttgccatttaacgccaatgaacaaatttcagtcattggtagcgtcagtttgcaacatctttacggcttgactttccgtatatttttgcctttacaaatgggttggaaattaggtggtgagcagttacattaccctgaatatttactggcagaaagtcgtcattatcgcacgctttggattagtagccctgccttattgagccatctcaacttggcaagtttggatcagcatgtgcagattgcaggtatcatttcatccggcggggcgttacccgaacaaaccgcccttgctttgcgagaggaattaccttgccccgttattgaaatttacggtagtaccgaaaccggtgcgattgcttttcgtcagcaaaccggcgggctttggcaagctatgccgaacactcggttgggattaaatgatgaagaggcgttgtgggttgaaaatgcatggattgtcggacgagagcaaacggcagatgcggtgcaatttagtgagcatgggtttgaattactgggaagaattgaccgcattatcaaattaggtgataagcgtttgtcattggtgaaaatagaacaagatttgctcaagcattgttttgtacaagattgctatattgcactacattgcctacatcagcgaccactagcttgggttgctttaaataaagaaggtattgcctattttaaacaacaaggacgtcaggcagttatttcacaatttcgccaacatttacgcctgacccaagaaaaatttgctttgcctcggtattggcgatttacggacaaattacctcgcaataaccaatctaaaatcagccgtttagattttgaaaaaatttgtaccgcacttgagtatgaggtatttgcatgacagcgtttaatcccattgcgatcattccccattataaccattctgcaacggtaggtagcgtcgctgaacagcttaatcaactagggctacctgtattgatcgttgatgatggctcaagtcttgaacataaagcagtgattgagcaatttccacaaaatgaacagctttccattttattttgtgaaatcaacggtggtaaaggtgctgcttttaaagcaggcttaaaacagacacaaaaacttggatttagccacgctattcaagtagatgcagatgggcagcataatataattgatgtcaagaaaatgctcgaacaagcggaaaaatcgccgaatgcaatagtatgtggtaaaccgatttatggcaaagatgctccaaaatctcgcttatatgggcgaaaaattaccgatttttggaatgcaatcaatacgttatcctttgatattaaagacgggatgtgtggttttcgaatttatcctattgctcaaattatgcccattcttgcacaagagcaaattggtggtggtatggattttgacacagaaattttaatccatagttattggcagaaaattccgcttatttgggttgataccccagtaaaatatgaaaaagatggcatctctcattttcgtggttgggcggataactggctgatcagcaaaatgcacgcacgccttttcttccgtatgctcaaacgactctttacaggaaaaattcgatgaataaacattgggcaaaacaacaagagcgtggtactgccttttttctaaccttaactcgtttaattgtgaagtatttgccattgcccataattcgagtagtgaatttttgggtggtgttatatttttatctcacttctcggcaaaaacggtgctacattgcagaatatcagcaaaaactgaccgctctttttcctgaaactaagttacctaaatatgcggtatttagacaatttctcgcttttggcgaagccattactgatcgtttcgccgtatggcaaaaaaaaattcgttatgaacatcttatcgttgatgatgcggataatctttatgcagatatcagcggcaatggtcgaggacaaattttggtttgctctcattttggcaatattgagatctgtcgggctttgttcggtagcggacagcacgaaaattttaaactgaatgtactggtacataatcgacatgccgtagcatttaacaaagcattgggtgatgcaggtgctgatgaattaccgctgattcaagtggaagacctcaatgtacaaaaaatgctggaacttgctgaaaaaattgatcgtggcgaatggattgcgattgccgccgaccgcattcccgtacgtggcgataaaacggagccggtcaattttttgggttctccagccgagtttcctcaaggtgcttggctgctggcaagtttattgaaagtgccgcttaataccatcttttgcatcaaagaacaggggcgttaccgtttgcagcttcgccgttttagtgaaagtattcaaggtcgaggaaaagtgcgtgaacagaatataagaaatgtcatgcaaaaatatgcggatttactggcaaaagaatgtgcaaaatcaccatttttgtggtttaatttctatgatttttggcatcgcaaagattaacttacttttctcaaggagattttatgaaactgatcaaaatattagctttaactttttctgcggttgtgattgttgcttgtgcacctcgtgatacaacccattatttatctattcaggaagccttaagttctcctgaggctaaaaaaatactgaatcctaaaatcaagctttattttggtaaacctgcaccgggtcaagtgattcaaaaaggggcggttaccaacccgaaaacgaatgcggtgaataaaacagataaagaagcgtgccaatgggtattcttatctgcagtgaaacgtttccaagatcaagcggtagctaaaggggtaactaaagtgggtaacctcgtgagttattacaagaaaaaagaatatagtagtaccactaaatatgagtgccatgccggtagaagtattgctggtgtagcattaaaaggcgattttgttaagtaaagctattaataatctaggataaacaagcggtttaatttcttgaaaaaatgagcaaaattaaaccgctcttttgcttaaaatgagacttaaaaaacacatttacgctgaacatttttccgactatgaaatcccattttttgatgtggactccatgtttattatgtggcatggtcattatgtcaaatatttagaaatggctcgctgtgcatttttagaagaaattcactatacctacgatgtgatgcgagaaaaaggttacggctggccaattgttcaacttcatttgaaatatgttaaacctgccgtatttcgccaaaaaattcgggtgcatttagctgttgtagaatacgaaagctgtatccgtattgattacaccattactgatttagccaccaaacaaaaactgacaaagggtagtaccacccaagttgccgttgatatttcaaccggtgaaatgcaattacaaacgccacaatcttggcgtgatgcgatagaaagctatcatgggtttattgctgagtgagagagcgttaatgaaaaaatatctttttgtcttgttaatattattatgttgcaaaaatctttgggctttttctcaggatgatttagtacatttgttacaaaagccacagaatacgcaaggtgaatttagtcaacaacgttatttaaaagccttaaccaaacccattatcacttcaggaaaatttattttaataaaaaataaagggttggtttgggaaacggaaaaaccgtttacacatcaattgaaagtgacggcaaaaggcattagccaatggaatggaacagcatgggaaaaccattctcgtttaggtcagggtgagcaaattaaactattcttaggcttattgtccggcgatattcaagcacttgcgacacaatttgacgtagtgctttcaggagatgaaaaaaattggcaacttcagctcatgcccagcagtttgctgatgaaacaaatttttaatcaaattattattcagggcaatgtagctgtgcaacgtattgaattgcatgaaaaacagggagatcgtaccttgattttgtttaataatcagcagattaaccttccattatcaccctttattcaatctgccttccaataggaatttgcatgcgcaaattattgaccgtttaccgcttaatttttgccggggttttatgtcttgtggtggcgatttttatgtatcatttacaaacaggtaaatggttacaaacggatctacatacacttttgccggacagtcaacactatacaaaaattcaattagaggcagataaacatcaagaacagcaatttaatcagcaagttattgcattggttggacattcacaatcagaagctgcttttaaattgacggaaaaagttgcagaacaatggcaaaaaagtgggttatttcaaacgttatctgtaaaaaatcaaccgaatttagctgaacttcaacagcagattgagttattaaaattagccacactgcctatttcaacacgaaatcagattattcaacagcccgaacgttattttcagcaatatgcagagcaaatcattaacccgttcggttatcaaaatttgctccccttggaacaagactggcttggttttgggcgttttgtattgtcgcaatctcagcagcaaagtcaaattcagtggcatgcagaaacaggtatgctctatgctgttcaacaaggtaagacatgggttttattaacaggcaaaattgttgattcagatttgatcaaacctcagcaaaatttaaccgcacttcttaagcaaaatgcacaatttattcaagaacaacaaggtcaatggttaagtacaggtgcggtgatttttgcggattattcacaacaacaagctaaatatgaaagcacgatcatgggcgggttaggtatcagcctaaccttgcttttactgttgctggttttccgtagcttacgcatattatggttatttttaccgatttctgtaggtatggttgcaggtattactgctactattagttgctttgggcagattcatattttaacgctcgtgattggcacgagtttagtgggtgttctgattgattttccattgcattggctgacatcatctctctttttgcgtcaatggaatgccaataaagcgatggcaaaacttcgccttactttttttgtcagcttattggtgactttgctgggttatgctttactgggatttactgctttacctatcctaaaacagaccgcacttttttccggtatggcgttgatttttgctgtcttaacgaccttcttgtatttgcctctatttttccgacattaccagtcaggtaagtcgttgtttttacgccgaattttgcaaataaatttccacgttaagattaattcattattaaataagattttatttgtggttagcacgggtttcattgtagtagggttgcagaaaagctattggcaagatgatattcgtcaatgggttgctatgccgatggaattgattgagcaggcacaaaaaattcgtcaaattaccggcattgatctaagcaatcaatacttattaattactgctgaaaataatgagcaattattgcaaaaagaccgaattctaaccgagaaattacaacggttcgcacaagaaaataatctgataaaatttcagtcattaagccaatggattatgtcaaaaaagcaacaagcggagtttattcaacagctaaaaaatattcctgctgaaagctatagcgtttttgatgaaattggtattccaaaggacatgattcgtcattcgctaaaaaaattggaaaaacagcctcttgttagcttagaacaggccttaaatacagaattgggaaaagtttggaaaaatctatatttaggtgagcttgatcgaggaaaagtagcaagtattattaaagtatcaggattgaataacccaaaaattcttgagcaaattgttaataatcgggatatttactggcaggataaacctgcccatctcaatcagttgtttgagcaaacccgcaaccaagcggcttggttaaaattgctctcatttggcttggcagctttattgttgtggcgaatgtttggcatatcgcaaacgttgaaaatgctcagtatcccgcttatttcagttgtgtgtacagtcgcaattttaggttggttaaatatcaccatcagtttgtttgctatgtttgggttattattggtgtcggtcattggtattgattacattgcctatatgcaaacagcgaaagagccgttatcaataaaacgttttacgattagccttgcagcacttaccacgcttatttcatttgctttattagggttaagttccactccggcggtagcaagttttggcttgagtgtcagtttgggtgtgttgattagcttaggaatgattttgcgaataaagtgaagtaatggtgaatatattttcacatcctatcttatggctgattaattgcgatagatatatcatttttatggcaaaacaggattgcataagcactaaaactcaaaaagggctgatgtcagccccttgttgttagcatcaaattaaaataataccctcgcacgaatagtgccttcaatttgcttaagtttagccaataattgagcggtatcttctgtttcaacatcgattaccacataaccaatttttgcctcggtttgtaaatattcagctgcaatattgatattttgctccacaaatatttgattgattttatttaaaatccccggacggttatggtgaatatgtaataagcgttttgcattactatgttccggtagagatacttctgggaaatttactgccgatagtgttgaaccattatcggaatatttgacaaatttatttgcgacttcaattccaatattttcttgtgcttcaacagttgagccaccaatgtgtggtgttaggataacattatcaaaagcacgcaatggcgagataaactcctcttcaatcgaggcaggttctttcgggaatacatcaattgcggcaccacgaatttttttgctttctaacgcctgagttaaagcgtcaatatcaaccactgtgccacgggcagcattgataaaaatacagttcgcctttaattgtgcaatgcgttccgcattcattaaattttttgttgaggaattttccggcaaatgtaatgaaaccacatcacaggtactcaaaagttcttctaagctattcatttgttgtgcattacctaaaggtaattttgtttctatatcatagaaatacacattcatgcctaacgcttctgcaataatacttagttgagatccaatatgaccataaccaataatacccaagcgttttccacgaacctcataagatcccaccatggatttattccataaacctcgatgcacatcggcattggcttgcgggatattacgcattaataataagatctcaccaagcaccaattcagccacagatctggtattggcaaacggtgcattgaaaacaggaataccacgtgcttttgccgcctctaaatccacttgatttgtgccgatacaaaaacaaccaattgcaattaattttgttgcttctgctaatatatcctccgttaaagacgttcgagaacggataccgataaaatgtgcatctttgatagcaatttttaattcttcaggttctaaagccttccgatgatattcgatattggtatatcctgctgcttttaacacctctaatgcattttggtgtattccctccaaaagcaaaaacttaatttttgatttatctagtgatacttttgttgtcatattgcctctccgtatatttaaataattattcaataatttttgtaccctccggcgtacctacaataacaatatctgcagaacgtaaagcaaaaatcccatttgttaccacgccggccacattattcaattctttttccatttctatcggattcataattttaaagttatatacatctaaaataacattaccattatctgtaagcacattttcacgatattcaggtgaaccgcccaacgccactaatttgcgtgcaacttgagagcgagccattggaatcacctctatcggcaaagcgaacgttgagcctaatacatccacttgtttagaactgtctactatacatatgaatttttttgccaatgcggctacaattttttcacgtgtcaatgctgctccgccacctttaatcatcattttttgcggattaatttcatctgcaccatcgacataaatatctaaaccggatacatcatttgcactgaatacctcgataccttgtcggagtaataattcttctgacgcttttgaagctgcgacagcacctttgattgtttcttttattgtacctaatacttcaataaaacaattgacagttgaaccgcttcctacgccaataatgctatcaggtttaacatattgcagtgcagcttgagcagccatttttttcatgcttaactgatccattttttatcctttttctatgattttatgtttatgtcgtacaaagcaaatgtttttataagttcactactttaaaactattcacttaaatacacaagctaatcaggcaaaaactccgttaataattcattaaggaaaagttttccttgttcagtgatttgccaagtgcggttcgtttctgataaatagttcttctctaacgcccaatcaatttgtttttgtaccgcactttgtgctaatccggttaacagttcaaattgttgtttttccataggttccaataaacgaaagcgattcataaaaaactcaaatggacgttctgaaaaagggatatttttttcctcatatagatattcaccacgcatatagcctttagggtgtttcgttttagaaaaacgtaaaatttgtccatcagcaaaactcaatttaccatgtgctccacacccaatagctaaataatcaccaaatctccaataattcaaattgtgttgacattgaaaatcaacttttgcataagcagaggtttcatattgttggtaacctgctttggataacaattgatgaccctgctcaaaaatatcccaaagttcatcttcatcgggtaatttcggcggacgatatgcaaacattgtattaggctcaattgtgagttgataccaagataaatgaggcggttttaaagcaatagcttgctgtaaatcgtccagtgcttgcaccaaagattgattgggtaatccgtgcattaaatccaagttaaaactgtttaatccggaatgttgagcaaaacgcaccgcactttttgcttcaactgcattatgggcacgccccagtctctgtaatttttcattattaaaactttgaatccctatagaaattcgattcactccggcttgtgcatatccgacaaaccgatcgctttcagctgttacaggatttgactcaagcgtaatttcaatattatcctcaaaaggaataagttgtttaatttgattcaataaataatcaatactttgtacagaaaataggctaggagttccgcctccaatgaaaatagaatgcaattttcggtcggctattgaggcatgataacgtaccaaatcttgctttaagtcagtaagcaaatgggtaacatattcagtttccggaataagccctttttgtacatgggagttgaaatcacaataagggcatttttgtacacaccaagggatatgtatatataaacttaatggaggtagctgaatgggaaatagtttaacaagggagaattgtgtcattatttcaaccgctcttttaatactgcgagagctttggctcgatgtgaaattttctttttctccgatgtttccagttcagcaaaagtacaacctgtttcaggatagaaaaataagctgtcataagcaaagccatttgaaccgctttcagaaaaagcaattattccatgacattcaccttcagcaataattggcgatggatcagtgtcatgttgcagcatgacaatacaactcacaaatttggcatgacgctcattaacgggcacattagccagttccgctaataacttttctctatttttctgctccgcatctttgccctcaactccggcatagcgagcggaatataatcctggtgcaccgtttagtacaggaacaaccaatccactgtcatcagcaatcgcaggtaagcctgacatttttgctgcataacgtgcttttagaagtgcattttctacaaaagtcaaacctgtttcttccggactgtcaatacctaaatctttttgtgcaataacatcaaaaccaaattcagataatacatttgccatttcttttactttcccaggattagctgttgctagtacaattttttgtttcattaccgttcctttttcaatgaataaccagtttgctattttaagcacttcgcaggtattttttaagatgctgttttaagataagtcccctgaatgataaaatatttttgctttctacagaaatatcccctcaacattgttaaaaattgaggggatattgatttatattgtcaaaagttatttggcatgtgtctagaaaatgatacgatctctattcttttctagtgttgctttgccaatccccttgacttcaagtaactgttcagccgcggtaaatttaccaaatttttcacgatattgaacaattgcctcggcttttttgcttccaattcctattaaagcgtgtttaatttcttccgctgttgcagtattgatgttcaatttatcgctaataatgacctgttcaacttgttgtgttgcttgggctgaactaggtggttgagttggtgtttctgcaaatgcattaaaagcacccaaagcaacacttaacatcaataatgatttgaaaaatgaggttatttttttcattttgtcttccttacagtaaatgataaccaaagtttaaaaaattgaactgttgaattgattcaacaacagacattttgcatggaggcgaaaaacttacgagaaaatcactgcacttttacgatcaagatcgcaaaaataacaaaatggattagcaaaaagagacttttttgtgaaaaaacgagtattcactaaaagcgaatccccgtttttttgaagagaaattattgacgtactgcgatagcttcaatttcaataccgacatcttttggtaagcgagctacttcaacacaagaacgtgctgggaaagttgggtgatgattttctataaagaaacgctcatactcggtatttactgtggtaaattgatttaagtctttcacaaaaacggtggttttaacaatatctgccacagtcaatcctgcttgtgcaagaattgctttaatattttccaaagattggcgagcttgtgccgtaatatctgccggaatttcccctgttgcaggattaaccggaatttgaccggaagttaaaactaaattacctaaatccacagcttggacataggggccaattgctgccggtgctttttctgtgtgaataacttttgtcattttttctccttaattcaacgatattttcacgctaactattgtacgcttttaaaaataaacttaaagcccattcatggcgtttatcaagcgaatttcttcatattgtgccagatcctcgaaaaaaatttctcttgcaataattttcttttgctcaagtaattttgctcgttgtgtaccttctaataacggtttatcgggagttatccattgattattttggcgaaaaatcaagtttccaatagagcaatccgttactttgccttgacgaataatcataatttcatcacattcttctttttgttttaagaggttgtttaacaatgttcgatctgaaaatttcaaactgtaatcaatatgatcacagaaaacaggtttaaaagttcgataaactttttgttgataaggaaagcattgaagaacgtaatcatgatggttgtaatcaatacggcaacgtattaagccttctcggtgggtgaaaagtgcggtatgtttagcaataatttttgctaaatcaaatggttgtaatttcattttgggataaaacttcagcaggcttttttcataacgttgctgatgataggaaatatttttagcttgaccttgttcaattaagatcgtttcaaataaaggaaattgccacattttctgttaataattatcaaatagtcatatctgcatcaaaaattatttctctacttaaatcttgagataaagaaataaaagctagctacttagttttcctcactattggataaaccgctgtttaggctctaaatagtccttaattcgcttattttatgaggggtaaatatactttagcacacagctcgttgtattcatcttctatatcactttgaattgtaatgccacctccgctacgaaaataatagccatcgcaccgtttctcaataaagcgaatagcgaccgcactttgtaaggtttctccatcaaaaataccaaaaacaccggtgtagtaacctctcttttgctgctccgcttgttgaataatttccaccgttttttcttttggtgcaccgctaatagaacccgccggtaatagtgcggctaaaatatgtccaatattatgtcgccaattttcctctaactcaccacaaatttcggaacttgtttgcaaaattgcacctcgttcagtatgaattttttcaacatagcgaaaacgtttaactttaatatttttagctacaatagctaaatcattacgcattaaatccacaatggtatagtgttcacacaactctttttgtgaatttagtaattgttgctcagcattttctaacgttgcatttatcgtgcccttcattggataggtgtaaattttattttcataaatttgaataaacggctcaggcgaaaaacaaataaattcatttttaaacaataacttataacttgcttttgtttgttgaaataactgcatcaaactataatttgtttcaattttgctcggataagtaagatttaacaaataagagttacctttttgtaactcgctcttaaccagctcaaatccctgctgataatctttaaatttcataggattaaatgaaaaatgacaatcttttgcggaaaattcaaaatgccaatctacattactttttattccttgcggttgtaaaatagtaaaaaagatattttcttttgctgcttgttcaatgggtaaaataattggtttttgctgttcaaaatcaatcaaaaagaaaaaaggtaatttattttgcccaaaataattagcctgccggacaaaatcaagaaattgacttgagttattcaatgacataacgatgaaaaatttagtaatatacgcaattcgctgattttagcttaagatgaaacatgaacacaaatttattagtcattaataatcatgactcttttacttataacttagtagatctcattcgccgtttaggcacgccttttaaagttgtgaatgtagaggatttatctttggtggaaatagaaaatttttctcacctgttaatttctccgggacctgatgttcctcatgcatatccccaactttttgatttactggaaaaatatcatcaatctaaatctattttgggtgtttgcttaggacatcaaactttatgtgaatttttcggcggaaaattgtataatttgcagaatgtacgtcatggacaagctaaacagctaaaagtgcggtctaattcgagactatttagaaatttacccttaacatttcaaattggactttatcattcttgggctgtaagtcctgaaaactttccggaagatcttgaaattactgcgatttgtgatgatgaagtaatcatggcgatgcaacataaaaccttgcccatttacggcgtacaatttcatcccgagtcttatatttcggagtttggtaagcaaatcatacaaaattggctaagtaattgataattataataaattcataataactattaaaaataaaaaaatgatagaaatttcctatgaattttatcaataatatccattttgttagtaaggaattattatttatcatataatcagtaaagacatcaataaacataaataggagaaagcttatgacaacaactatcggtttagatcgcaatagttcaaaacaattagcaacagaattaaataatttattagcaagttatcaaatattctacatgaatgtacgtggctatcattggaatattaaaggtgtaaatttctttgaattacacgcaaaatttgaagagatttatgatgatttagtggtgaaagtagatgaaattgcagaacgtattttaactttaggttataccccaagcaatgcgtttagtgaatatttgacacaatcgcaaattcaggagcatattaatgtaactaacgcacaggactgtttaaacggtaccctacaagggtttaaaacattgttaaaacaacaacgtagtatccttgctattgcatcagatgccaatgatgaaggtaccgcttcgcaaatgagtgattatattaaagagcatgagaaattaatttggatgttcagtgcggcttgtgaaagttgtcatgcttaatttgtgtaatatcacatcattttaaatctaaaagttaaaataaaacctctagctgtgcctagaggttttttcgtttatatgaaaagctaaatattgtgtttatttgccgatacagaaagagctaaaaatattgcctaataaatcatcggaagtaaattgtcctgtaatttcacttagatgatgttgcactatacgcagttcttcagcgactaattcacctgcataaaattctgtcaactgaatcaatccggcttgtaaatgaatgtcggcttgttctaaggcctctaaatgacgacgacgggctaaaaatcccccctcagtgcagacttgatagcccatggactgttttaaatgctgacgcaacaaatcaacacctttttgtgtttttgccgacaatgaaataacagttaaaccgttttgttcatctaaaacttctgcttcaccacttaaatcagctttgtttcttactatggttaaaggaatatgtggcggtaattttgccataaattcagaccgcactaaatccaattcaacttgattttccgtgctatccaagattaacaaaatacgatcagcctgttcaatttcatcccaagcacgacgaataccaattttttcgacctcatcggttgcatcacgtaaccctgccgtatcaataatatgtaaaggcattccgtcaatatgaatatgctcacgcaaaacatctcgagttgttccagcaatatccgtaacaattgccgcctcacgccctgctagtgtgtttaataaactggattttccggcatttgggcgaccggcaatgactactttcattccttcacgtaaaatagccccttgttttgcctcattttttactttagctaacttggctattatttcacgtaaatgcgtttcaattttaccgtctgcaagaaagtcaatttcttcgtcagggaaatcaattgctgcttcaacataagtgcgtaaataaataactgagtcaactaattcattgattttatttgaaaactcaccttgcaatgattttaacgcagaacgtgctgcttgctccgaactcgcctcaattaaatcagcaattgcttctgcttgagctaaatctaatttatcattaagaaacgcctgttcagaaaattcgcccggtcgtgccaaacgaataccgtcaatttgcaaaatacgttttaataaaagatccatgacgatttgtccgccatgtccttgtaactcaagaacattttctccggtaaaagaattgggtgctttaaaataaagtgctatcccttgatctaatacactaccatcagaatctttaaatggaagataatttgccatcctaggtgttaaggttttaccgagtacttgttcagcaacctgctgagctaaaggtcctgatacacgtaaaatcccaactccaccacgtccaataggcgttgcttgagctacaatagtatctctactcataatttgtttccaaaagtgcggtcaaaaatcgtatagaattataacaaaaaaggcatcatctaagatgcctttcttttatttaggattatttttttactctagtatgtaagccttttttctccaaaccacgataaattaaccattgttgtgcaatagtaataaggttagaggctaaccaatataacactaagcctgcggggaagaataagaagaacaccatgaaaattaatggcataaacgtcatgaccttttgttgcatcggatcggcaacaggtgttggtgacattttttgcaataggaacattgaggcacccattaggatcggtaagataaaatacggatcctgtgcggataaatcttgtacccaaccaaagaatggggcatgacgtaattcaacggcttccataaatgtccaatacaaagcaatgaaaattggcatttgtagaagaattggtaagcaaccgccaagaggattgactttctcttctttgtaaagtttcatcatttcttggctcatacgttggcgatcttcaccaaaacgctcacgcatttcttgcaatttaggttgtaacatacgcatttttgccatcgacgtatattgtgctttggttaacgggtatagaattgcttttactactaaagtgacaccaataattgccagaccccagttttgtacaagagattggatcagggttagcaatttaaatagaggtttcgcaataaaccaagcccaaccataatcaacggttaaatccaaatgattagccacatcagccatttgatcttgtaatttcggaccagtccataattgagtatgaatagtttcagttgcaccgttttctattacaatcggagcagatcgataaccaatagaacccaagtgtttcttagtatttgtcagcgtgtacaaggtattattagcatcttgattaggaatccaagcggagacgaaataatgttgcaacaaggcaacccaaccggctttggtatgaatatctaaatctgctttttccatgtcttcaaaactatattttttatagttggtttctgacgatgaataagcaccgccggtataagtcggcattgccatgctacctgaactttcaactagtgtatgagttaattgtgcataaggaactacttcaatcggttttgggctttggttggtaatttcaaaattgacctctaatgcgtaagatccgggttttaatacaaagattttacgatagatcacaccatctttctcaaagaccaaaggcacttttaattcctgctgaccttctgctaacttaaatacatcaccttcaacttggtaatttgcacgaccagcacgactatcaatgccattttttccgactaagccgctttgtgcaatatatactttatccgcattgttctgtaataatacgaaaggtgttgaagaatgtaattctgcatcatagttcaataattcagaaccgatcacgtccccccccaaagtatttacctttaaacggagaacatcattttctaatgtaataacacgacctttagcctgtgtatcattagcaatatctgacgttgctgtaagtgcggttgagttcacttcagaaacctgagcttgttcagtcacttccggcttaggcgtgttatagtctacttgccattgctgataaataaggaaggaaatgaaaagaagtgccataaataataggctgcgtttagaatccattattcgttctctttgttgttattaatctttgggggaacaggatcgtatccgcccacattaaaaggatgacattttaatatacgtttaactgtaagccaactaccttttactacaccatgcgtttttactgcttgaataccataacaagaacaagttggcacaaaacgacagcgaggaccaatcagcgggctaatcatcaattgataaatcctaattgcaccaattaagacttttgcaccaaacgaatgtgacgtttccatagcttatccaaagtttgaaataattgctggttatctaaattaccaatacctttctttgttattattacaaaatcataattagccagctgtccttgtaataaacggaaactttcacgagaaatgcgtttaa
